(12) United States Patent
Juneja

(10) Patent No.: US 12,246,067 B2
(45) Date of Patent: Mar. 11, 2025

(54) NEOANTIGENS AND USES THEREOF

(71) Applicant: BioNTech US Inc., Cambridge, MA (US)

(72) Inventor: Vikram Juneja, Waltham, MA (US)

(73) Assignee: BioNTech US Inc., Cambridge, MA (US)

( * ) Notice: Subject to any disclaimer, the term of this patent is extended or adjusted under 35 U.S.C. 154(b) by 139 days.

(21) Appl. No.: 17/254,128

(22) PCT Filed: Jun. 19, 2019

(86) PCT No.: PCT/US2019/038019
§ 371 (c)(1),
(2) Date: Dec. 18, 2020

(87) PCT Pub. No.: WO2019/246286
PCT Pub. Date: Dec. 26, 2019

(65) Prior Publication Data
US 2021/0268091 A1  Sep. 2, 2021

Related U.S. Application Data

(60) Provisional application No. 62/800,735, filed on Feb. 4, 2019, provisional application No. 62/687,188, filed on Jun. 19, 2018.

(51) Int. Cl.
| | |
|---|---|
| A61K 47/20 | (2006.01) |
| A61K 38/00 | (2006.01) |
| A61K 39/00 | (2006.01) |
| A61K 45/06 | (2006.01) |
| A61K 47/26 | (2006.01) |
| C07K 14/62 | (2006.01) |
| C12N 5/0783 | (2010.01) |

(52) U.S. Cl.
CPC ...... *A61K 47/20* (2013.01); *A61K 39/001164* (2018.08); *A61K 39/4611* (2023.05); *A61K 39/4632* (2023.05); *A61K 39/464401* (2023.05); *A61K 39/464464* (2023.05); *A61K 45/06* (2013.01); *A61K 47/26* (2013.01); *C07K 14/62* (2013.01); *C12N 5/0638* (2013.01); *A61K 38/00* (2013.01); *A61K 2039/55511* (2013.01); *A61K 2039/575* (2013.01); *A61K 2039/645* (2013.01)

(58) Field of Classification Search
CPC ............ A61K 39/4611; A61K 39/4632; A61K 39/464401; C07K 7/06
See application file for complete search history.

(56) References Cited

U.S. PATENT DOCUMENTS

| | | | |
|---|---|---|---|
| 4,683,195 A | 7/1987 | Mullis et al. | |
| 5,827,516 A | 10/1998 | Urban et al. | |
| 5,847,095 A | 12/1998 | Bos et al. | |
| 5,910,407 A | 6/1999 | Vogelstein et al. | |
| 5,961,978 A | 10/1999 | Gaudernack et al. | |
| 5,973,007 A | 10/1999 | Demarchez et al. | |
| 6,020,124 A | 2/2000 | Sorenson | |
| 6,090,546 A | 7/2000 | Breivik et al. | |
| 6,121,434 A | 9/2000 | Peyman et al. | |
| 6,156,504 A | 12/2000 | Gocke et al. | |
| 6,300,081 B1 | 10/2001 | Taylor et al. | |
| 6,436,700 B1 | 8/2002 | Roth et al. | |
| 6,440,661 B1 | 8/2002 | Øgreid et al. | |
| 6,534,064 B1 | 3/2003 | O'Hagan et al. | |
| 6,599,704 B2 | 7/2003 | Wagener | |
| 6,627,189 B1 | 9/2003 | Roth et al. | |
| 6,630,301 B1 | 10/2003 | Gocke et al. | |
| 6,743,444 B2 | 6/2004 | Jones et al. | |
| 6,919,318 B1 | 7/2005 | Paliard | |
| 6,998,117 B1 | 2/2006 | Roth et al. | |
| 7,329,649 B2 | 2/2008 | Fisher et al. | |
| 7,465,454 B2 | 12/2008 | Franzusoff et al. | |
| 7,514,416 B2 | 4/2009 | Aoki et al. | |
| 7,563,447 B2 | 7/2009 | Franzusoff et al. | |
| 7,709,002 B1 | 5/2010 | Schlom et al. | |
| 7,731,967 B2 | 6/2010 | O'Hagan et al. | |
| 7,749,505 B2 | 7/2010 | Wang et al. | |
| 8,343,502 B2 | 1/2013 | Franzusoff et al. | |
| 8,501,167 B2 | 8/2013 | Apelian et al. | |
| 8,529,906 B2 | 9/2013 | O'Hagan et al. | |
| 8,679,788 B2 | 3/2014 | Eshleman et al. | |
| 8,809,290 B2 | 8/2014 | Bot et al. | |

(Continued)

FOREIGN PATENT DOCUMENTS

| | | | |
|---|---|---|---|
| CA | 2343602 A1 | 10/2001 | |
| CA | 2988388 A1 | 10/2016 | |

(Continued)

OTHER PUBLICATIONS

Gjertsen et al Int. J. Cancer vol. 72 p. 784 (1997) (Year: 1997).*
Jun et al Tissue Antigens vol. 84 p. 277 (2014). (Year: 2014).*
Acevedo et al., Analysis of the mechanisms mediating tumor-specific changes in gene expression in human liver tumors, Cancer Res, 68(8):2641-2651 (2008).
Adams, Toll-like receptor agonists in cancer therapy, Immunotherapy, 1(6):949-964 (2009).
Adomas, et al. "Breast tumor specific mutation in GATA3 affects physiological mechanisms regulating transcription factor turnover," BMC Cancer 2014, 14:278.

(Continued)

*Primary Examiner* — Sheela J. Huff
(74) *Attorney, Agent, or Firm* — Wilson Sonsini Goodrich & Rosati

(57) ABSTRACT

Disclosed herein relates to immunotherapeutic compositions comprising immunotherapeutic peptides comprising neoepitopes, polynucleotides encoding the immunotherapeutic peptides, antigen presenting cells comprising the immunotherapeutic peptides or polynucleotides, or T cell receptors specific for the neoepitopes. Also disclosed herein is use of the immunotherapeutic compositions.

19 Claims, 10 Drawing Sheets

Specification includes a Sequence Listing.

(56) References Cited

U.S. PATENT DOCUMENTS

| | | |
|---|---|---|
| 8,822,182 B2 | 9/2014 | Celis |
| 8,883,448 B2 | 11/2014 | Schlom et al. |
| 8,889,642 B2 | 11/2014 | Shemi et al. |
| 8,999,937 B2 | 4/2015 | Srinivasan |
| 9,493,845 B2 | 11/2016 | Cao et al. |
| 9,687,491 B1 | 6/2017 | Rabizadeh et al. |
| 9,743,646 B2 | 8/2017 | Shi et al. |
| 9,757,439 B2 | 9/2017 | Eriksen et al. |
| 9,775,833 B2 | 10/2017 | Sanchez et al. |
| 9,862,927 B2 | 1/2018 | Banchereau et al. |
| 9,872,894 B2 | 1/2018 | Erickson |
| 2002/0034551 A1 | 3/2002 | Jones et al. |
| 2002/0165196 A1 | 11/2002 | Wickstrom |
| 2003/0104067 A1 | 6/2003 | O' Hagan et al. |
| 2003/0124128 A1 | 7/2003 | Lillie et al. |
| 2003/0133910 A1 | 7/2003 | You et al. |
| 2003/0203397 A1 | 10/2003 | Wagener |
| 2004/0029114 A1 | 2/2004 | Mack et al. |
| 2004/0076955 A1 | 4/2004 | Mack et al. |
| 2004/0087478 A1 | 5/2004 | Gillen et al. |
| 2004/0106109 A1 | 6/2004 | Belly et al. |
| 2004/0121348 A1 | 6/2004 | Kreutzer et al. |
| 2004/0156858 A1 | 8/2004 | Franzusoff et al. |
| 2005/0107322 A1 | 5/2005 | O'Hagan et al. |
| 2005/0222062 A1 | 10/2005 | Arai et al. |
| 2005/0260167 A1 | 11/2005 | Aoki et al. |
| 2005/0281779 A1 | 12/2005 | Paliard |
| 2005/0287127 A1 | 12/2005 | Li et al. |
| 2006/0154238 A1 | 7/2006 | Hu |
| 2006/0193855 A1 | 8/2006 | Bot et al. |
| 2007/0055049 A1 | 3/2007 | Grey et al. |
| 2007/0224208 A1 | 9/2007 | Guo et al. |
| 2007/0298419 A1 | 12/2007 | Park et al. |
| 2008/0293055 A1 | 11/2008 | Freeman et al. |
| 2009/0041792 A1 | 2/2009 | Belardelli et al. |
| 2009/0075267 A1 | 3/2009 | Siena et al. |
| 2009/0136494 A1 | 5/2009 | Ponath et al. |
| 2009/0142366 A1 | 6/2009 | Franzusoff et al. |
| 2009/0175825 A1 | 7/2009 | Aoki et al. |
| 2009/0208458 A1 | 8/2009 | Hatakeyama et al. |
| 2009/0270482 A1 | 10/2009 | Schuebeler et al. |
| 2009/0304735 A1 | 12/2009 | Belz et al. |
| 2010/0074945 A1 | 3/2010 | Schlom et al. |
| 2010/0105051 A1 | 4/2010 | Lillie et al. |
| 2010/0239607 A1 | 9/2010 | O'Hagan et al. |
| 2010/0278857 A1 | 11/2010 | Mohamadzadeh et al. |
| 2010/0286241 A1 | 11/2010 | Xie et al. |
| 2011/0034368 A1 | 2/2011 | Carson et al. |
| 2011/0059081 A1 | 3/2011 | Bacus |
| 2011/0092388 A1 | 4/2011 | Lillie et al. |
| 2011/0097743 A1 | 4/2011 | Bihain et al. |
| 2011/0150909 A1 | 6/2011 | Franzusoff et al. |
| 2011/0165162 A1 | 7/2011 | Hoey et al. |
| 2011/0182937 A1 | 7/2011 | Banchereau et al. |
| 2011/0207143 A1 | 8/2011 | Hayden et al. |
| 2011/0217309 A1 | 9/2011 | Buck et al. |
| 2011/0223188 A1 | 9/2011 | Langermann |
| 2011/0257890 A1 | 10/2011 | Weinschenk et al. |
| 2011/0274705 A1 | 11/2011 | Bot et al. |
| 2012/0064035 A1 | 3/2012 | Hadden et al. |
| 2012/0065140 A1 | 3/2012 | Goronzy et al. |
| 2012/0082691 A1 | 4/2012 | Rammensee |
| 2012/0141478 A1 | 6/2012 | Coupade |
| 2012/0214828 A1 | 8/2012 | Hatzivassiliou et al. |
| 2012/0264129 A1 | 10/2012 | Freeman et al. |
| 2012/0288509 A1 | 11/2012 | Schuebeler et al. |
| 2012/0288539 A1 | 11/2012 | Eber |
| 2012/0288862 A1 | 11/2012 | Xu et al. |
| 2012/0322858 A1 | 12/2012 | Kreutzer et al. |
| 2013/0039894 A1 | 2/2013 | Ahnert-Hilger et al. |
| 2013/0102595 A1 | 4/2013 | Bao et al. |
| 2013/0210014 A1 | 8/2013 | Sharman |
| 2013/0217710 A1 | 8/2013 | Alves-Aivado et al. |
| 2013/0225424 A1 | 8/2013 | Bacus |
| 2013/0231346 A1 | 9/2013 | Gilmer et al. |
| 2013/0243789 A1 | 9/2013 | Carson et al. |
| 2013/0323279 A1 | 12/2013 | Nixon et al. |
| 2013/0338077 A1 | 12/2013 | Srinivasan |
| 2013/0344097 A1 | 12/2013 | Guo et al. |
| 2014/0056986 A1 | 2/2014 | Desai et al. |
| 2014/0234351 A1 | 8/2014 | Bender et al. |
| 2014/0322344 A1 | 10/2014 | Shiku et al. |
| 2015/0164895 A1 | 6/2015 | Hatzivassiliou et al. |
| 2015/0202272 A1 | 7/2015 | Lauterbach et al. |
| 2015/0322532 A1 | 11/2015 | Skog et al. |
| 2015/0368360 A1 | 12/2015 | Liang et al. |
| 2016/0058854 A1 | 3/2016 | Bender et al. |
| 2016/0252511 A1 | 9/2016 | Czerniecki et al. |
| 2016/0264627 A1 | 9/2016 | Henning et al. |
| 2016/0317654 A1 | 11/2016 | Noelle et al. |
| 2016/0331820 A1 | 11/2016 | Eriksen |
| 2016/0331821 A1 | 11/2016 | Levey et al. |
| 2016/0331822 A1 | 11/2016 | Hacohen et al. |
| 2016/0331834 A1 | 11/2016 | Mondoulet et al. |
| 2016/0367651 A1 | 12/2016 | Shiku et al. |
| 2016/0377631 A1 | 12/2016 | Kuchroo et al. |
| 2017/0015718 A1 | 1/2017 | Rebollo Garcia et al. |
| 2017/0042855 A1 | 2/2017 | Summa |
| 2017/0065694 A1 | 3/2017 | Eriksen et al. |
| 2017/0073429 A1 | 3/2017 | Hansen et al. |
| 2017/0114413 A1 | 4/2017 | Hahn et al. |
| 2017/0122946 A1 | 5/2017 | Krizman et al. |
| 2017/0160269 A1 | 6/2017 | Linnemann et al. |
| 2017/0189515 A1 | 7/2017 | Eriksen |
| 2017/0204140 A1 | 7/2017 | Suphioglu |
| 2017/0218393 A1 | 8/2017 | Frazer et al. |
| 2017/0253633 A1 | 9/2017 | Mahr et al. |
| 2017/0261508 A1 | 9/2017 | Czerniecki et al. |
| 2017/0304421 A1 | 10/2017 | Wang et al. |
| 2017/0340751 A1 | 11/2017 | Jiang et al. |
| 2018/0088121 A1 | 3/2018 | Gerhard et al. |
| 2018/0153975 A1 | 6/2018 | Fritsch et al. |
| 2019/0099475 A1 | 4/2019 | Benz et al. |
| 2023/0398218 A1 | 12/2023 | Juneja |

FOREIGN PATENT DOCUMENTS

| | | |
|---|---|---|
| EP | 0852234 A1 | 7/1998 |
| EP | 0655090 B1 | 12/2000 |
| EP | 0668782 B1 | 4/2001 |
| EP | 0791074 B1 | 2/2002 |
| EP | 1264601 A2 | 12/2002 |
| EP | 1338606 A1 | 8/2003 |
| EP | 0868529 B1 | 10/2003 |
| EP | 1498145 A1 | 1/2005 |
| EP | 1073749 B1 | 1/2006 |
| EP | 1394272 B1 | 3/2006 |
| EP | 1747283 | 1/2007 |
| EP | 1867661 A1 | 12/2007 |
| EP | 1062366 B1 | 6/2009 |
| EP | 2105511 A1 | 9/2009 |
| EP | 2118322 | 11/2009 |
| EP | 2121989 | 11/2009 |
| EP | 1221968 B1 | 1/2010 |
| EP | 2044125 B1 | 9/2010 |
| EP | 2236516 A1 | 10/2010 |
| EP | 2358905 | 8/2011 |
| EP | 2390363 A1 | 11/2011 |
| EP | 2470898 | 7/2012 |
| EP | 2484774 A2 | 8/2012 |
| EP | 2506875 | 10/2012 |
| EP | 2414388 B1 | 11/2012 |
| EP | 2557923 | 2/2013 |
| EP | 2121989 B1 | 1/2014 |
| EP | 2004666 B1 | 9/2014 |
| EP | 2323630 B1 | 11/2014 |
| EP | 2500437 B1 | 11/2016 |
| EP | 3134083 | 3/2017 |
| EP | 3167293 | 5/2017 |
| EP | 2465950 B1 | 7/2017 |
| EP | 2520660 B1 | 1/2018 |
| EP | 3277678 A1 | 2/2018 |
| JP | 2003517274 A | 5/2003 |
| JP | 2003523365 A | 8/2003 |

(56) References Cited

FOREIGN PATENT DOCUMENTS

| | | |
|---|---|---|
| JP | 2003535024 A | 11/2003 |
| JP | 2019513373 A | 5/2019 |
| WO | WO-9403205 A1 | 2/1994 |
| WO | WO-9420127 A1 | 9/1994 |
| WO | WO-9503787 A1 | 2/1995 |
| WO | WO-9910382 A1 | 3/1999 |
| WO | WO-0066153 A1 | 11/2000 |
| WO | WO-0100225 A1 | 1/2001 |
| WO | WO-0155177 A2 | 8/2001 |
| WO | WO-2005103293 A1 | 11/2005 |
| WO | WO-2006121168 A1 | 11/2006 |
| WO | WO-2008096831 A1 | 8/2008 |
| WO | WO-2008112269 A2 | 9/2008 |
| WO | WO-2008112274 A2 | 9/2008 |
| WO | WO-2010033949 A1 | 3/2010 |
| WO | WO-2010071821 A1 | 6/2010 |
| WO | WO-2011028540 A1 | 3/2011 |
| WO | WO-2011068840 A1 | 6/2011 |
| WO | WO-2011130628 A1 | 10/2011 |
| WO | WO-2011146862 A1 | 11/2011 |
| WO | WO-2012079000 A1 | 6/2012 |
| WO | WO-2012095639 A2 | 7/2012 |
| WO | WO-2012101112 A1 | 8/2012 |
| WO | WO-2012159643 A1 | 11/2012 |
| WO | WO-2012159754 A2 | 11/2012 |
| WO | WO-2013026027 A1 | 2/2013 |
| WO | WO-2013039889 A1 | 3/2013 |
| WO | WO-2013071295 A2 | 5/2013 |
| WO | WO-2013086464 A1 | 6/2013 |
| WO | WO-2013123031 A2 | 8/2013 |
| WO | WO-2013151672 A2 | 10/2013 |
| WO | WO-2013166321 A1 | 11/2013 |
| WO | WO-2013173223 A1 | 11/2013 |
| WO | WO-2013176915 A1 | 11/2013 |
| WO | WO-2014011987 A1 | 1/2014 |
| WO | WO-2014012051 A1 | 1/2014 |
| WO | WO-2014018863 A1 | 1/2014 |
| WO | WO-2014056986 A1 | 4/2014 |
| WO | WO-2014134165 A1 | 9/2014 |
| WO | WO-2014150924 A2 | 9/2014 |
| WO | WO-2014172606 A1 | 10/2014 |
| WO | WO-2014184744 A1 | 11/2014 |
| WO | WO-2014191128 A1 | 12/2014 |
| WO | WO-2014197369 A1 | 12/2014 |
| WO | WO-2015085233 A1 | 6/2015 |
| WO | WO-2015086590 A2 | 6/2015 |
| WO | WO-2015107081 A1 | 7/2015 |
| WO | WO-2015123532 A1 | 8/2015 |
| WO | WO-2015161272 A1 | 10/2015 |
| WO | WO-2015161273 A1 | 10/2015 |
| WO | WO-2016007963 A1 | 1/2016 |
| WO | WO-2016011487 A1 | 1/2016 |
| WO | WO-2016020710 A1 | 2/2016 |
| WO | WO-2016085904 A1 | 6/2016 |
| WO | WO-2016100975 A1 | 6/2016 |
| WO | WO-2016141324 A2 | 9/2016 |
| WO | WO-2016144976 A1 | 9/2016 |
| WO | WO-2016154047 A2 | 9/2016 |
| WO | WO-2016144976 A9 | 10/2016 |
| WO | WO-2016156478 A1 | 10/2016 |
| WO | WO-2016161361 A1 | 10/2016 |
| WO | WO-2016186445 A1 | 11/2016 |
| WO | WO-2016187508 A2 | 11/2016 |
| WO | WO-2016202937 A1 | 12/2016 |
| WO | WO-2017004153 A1 | 1/2017 |
| WO | WO-2017011710 A2 | 1/2017 |
| WO | WO-2017019767 A1 | 2/2017 |
| WO | WO-2017030506 A1 | 2/2017 |
| WO | WO-2017031353 A1 | 2/2017 |
| WO | WO-2017048593 A1 | 3/2017 |
| WO | WO-2017069958 A2 | 4/2017 |
| WO | WO-2017074788 A1 | 5/2017 |
| WO | WO-2017088012 A1 | 6/2017 |
| WO | WO-2017139694 A1 | 8/2017 |
| WO | WO-2017148888 A1 | 9/2017 |
| WO | WO-2017173321 A1 | 10/2017 |
| WO | WO-2017180989 A2 | 10/2017 |
| WO | WO-2017181061 A1 | 10/2017 |
| WO | WO-2017184590 A1 | 10/2017 |
| WO | WO-2017223085 A2 | 12/2017 |
| WO | WO-2018026691 A1 | 2/2018 |
| WO | WO-2018037416 A1 | 3/2018 |
| WO | WO-2018102613 A2 | 6/2018 |
| WO | WO-2018140391 A1 | 8/2018 |
| WO | WO-2018148671 A1 | 8/2018 |
| WO | WO-2019094642 A1 | 5/2019 |
| WO | WO-2019168984 A1 | 9/2019 |
| WO | WO-2019246286 A1 | 12/2019 |
| WO | WO-2020089433 A2 | 5/2020 |
| WO | WO-2020132586 A1 | 6/2020 |
| WO | WO-2020252039 A1 | 12/2020 |
| WO | WO-2022036142 A2 | 2/2022 |

OTHER PUBLICATIONS

Akiyama et al., GATA-4 and GATA-5 transcription factor genes and potential downstream antitumor target genes are epigenetically silenced in colorectal and gastric cancer, Mol Cell Biol, 23:8429-8439 (2003).

Alarcon et al., DNA vaccines: technology and application as antiparasite and anti-microbial agents, Advances in Parasitology, 42:343-410 (1999).

Albert et al., "Direct Selection of Human Genomic Loci by Microarray Hybridization," Nat Methods, 4(11): 903-905 (2007).

Ali et al., In situ regulation of DC subsets and T cells mediates tumor regression in mice, Cancer Immunotherapy, 1(8):1-10 (2009).

Ali et al., "Infection-mimicking materials to program dendritic cells in situ," Nat Mater, 8:151-8 (2009).

Allison, "The Mode of Action of Immunological Adjuvants," Dev Biol Stand, 92: 3-11 (1998).

Almeida et al., "CTdatabase: a knowledge-base of high-throughput and curated data on cancer-testis antigens," Nucleic acids research, 37:D816-819 (2008).

Altman et al., Phenotypic analysis of antigen-specific T lymphocytes, Science, 274(5284):94-6 (1996).

Alvarez, Present and future evolution of advanced breast cancer therapy, Breast Cancer Research, 12(Suppl 2):S1 (2010).

Alyea et al., "Toxicity and Efficacy of Defined Doses of CD4+ Donor Lymphocytes for Treatment of Relapse After Allogeneic Bone Marrow Transplant," Blood, 91(10):3671-3680 (1998).

Amara et al., "Control of a mucosal challenge and prevention of AIDS by a multiprotein DNA/MVA vaccine," Science, 292(5514):69-74 (2001).

Amato et al., "Vaccination of metastatic renal cancer patients with MVA-5T4: a randomized, double-blind, placebo-controlled phase III study," Clin Can Res, 16(22):5539-47 (2010).

Amato et al., "Vaccination of renal cell cancer patients with modified vaccinia ankara delivering tumor antigen 5T4 (TroVax) administered with interleukin 2: a phase II trial," Clin Cancer Res, 14(22):7504-10 (2008).

Anders et al., HTSeq-A Python framework to work with high-throughput sequencing data, Bioinformatics, 31(2):166-169 (2015).

Andersen et al., Parallel detection of antigen-specific T cell responses by combinatorial encoding of MHC multimers, Nature protocols, 7(5):891-902 (2012).

Anderson et al., "Next Generation DNA Sequencing and the Future of Genomic Medicine," Genes, 1:38-69 (2010).

Andreatta et al., Gapped sequence alignment using artificial neural networks: application to the MHC class I system, Bioinformatics 32(4):511-517 (2016).

Annunziata et al., "Frequent Engagement of the Classical and Alternative NF-KB Pathways by Diverse Genetic Abnormalities in Multiple Myeloma," Cancer Cell, 12(2):115-130 (2007).

Antoine et al., "The complete genomic sequence of the modified vaccinia Ankara strain: comparison with other orthopoxviruses," Virology, 244(2):365-96 (1998).

(56) References Cited

OTHER PUBLICATIONS

Antonis et al., "Vaccination with recombinant modified vaccinia virus Ankara expressing bovine respiratory syncytial virus (bRSV) proteins protects calves against RSV challenge," Vaccine, 25(25):4818-4827 (2007).
Applicant's Authorization and Release Form of the Massachusetts General Hospital, Aug. 12, 2008; and Supplemental Release to Applicant of the Partners Healthcare System, Aug. 13, 2008.
Attia et al., "Autoimmunity Correlates With Tumor Regression in Patients With Metastatic Melanoma Treated with Anti-Cytotoxic T-Lymphocyte Antigen-4," J Clin Oncol, 23.(25): 6043-6053 (2005).
Aucouturier et al., "Adjuvants designed for veterinary and human vaccines," Vaccine, 19(17-19):2666-2672 (2001).
Austen et al., "Mutations in the ATM Gene Lead to Impaired Overall and Treatment-Free Survival that is Independent of IGVH Mutation Status in Patients with B-CLL," Blood, 106(9): 3175-3182 (2005).
Ausubel, A botanical macroscope, Proceedings of the National Academy of Sciences, 106(31):12569-12570 (2009).
Avogadri et al. "Modulation of CTLA-4 and GITR for Cancer Immunotherapy," Curr Top Microbiol Immunol, 344:211 (2011).
Azvolinsky et al., "PD-1 Inhibitor MK-3475 Again Shows Promise in Advanced Melanoma," Cancer Network, 2013. [Retrieved online] http://www.cancernetwork.com/melanoma/pd-1-inhibitor-mk-3475-again-shows-promise-advanced-melanoma.
Bachem et al., "Superior antigen cross-presentation and XCR1 expression define human CD11c+ CD141+ cells as homologues of mouse CD8+ dendritic cells," Journal of Experimental Medicine, 207(6):1273-1281 (2010).
Bachireddy et al., "Reversal of in situ T cell exhaustion during effective human anti-leukemia responses to donor lymphocyte infusion," Blood, 123(9):1412-1421 (2013).
Backert et al., Immunoinformatics and epitope prediction in the age of genomic medicine, Genome Medicine, 7:119 (2015).
Baden et al., "First-in-human evaluation of the safety and immunogenicity of a recombinant adenovirus serotype 26 FfIV-1 Env vaccine (IPCAVD 001)," J Infect Dis, 207(2):240-247 (2012).
Balaggan et al., "Stable and efficient intraocular gene transfer using pseudotyped EIAV lentiviral vectors," J Gene Med, 8:275-285 (2005).
Balakrishnan et al, "Novel Somatic and Germline Mutations in Cancer Candidate Genes in Glioblastoma, Melanoma, and Pancreatic Carcinoma," Cancer Res, 67: 3545-3550 (2007).
Balazsi et al., Cellular decision making and biological noise: from microbes to mammals, Cell, 144(6):910-925 (2011).
Balch et al., Final version of 2009 AJCC melanoma staging and classification, Journal of clinical oncology, 27(36):6199-6206 (2009).
Barbie et al., Systematic RNA interference reveals that oncogenic KRAS-driven cancers require TBK1, Nature, 462:108-112 (2009).
Barretina et al., The Cancer Cell Line Encyclopedia enables predictive modelling of anticancer drug sensitivity, Nature, 483:603-607 (2012).
Baskar et al., "Autologous Lymphoma Vaccines Induce Human T Cell Responses Against Multiple, Unique Epitopes," J Clin Invest, 113:1498-1510 (2004).
Bassani-Sternberg et al., Mass Spectrometry of Human Leukocyte Antigen Class I Peptidomes Reveals Strong Effects of Protein Abundance and Turnover on Antigen Presentation, Mol Cell Proteomics, 14:658-673 (2015).
Baurain et al., "High Frequency of Autologous Anti-Melanoma CTL Directed Against an Antigen Generated by a Point Mutation in a New Helicase Gene," J Immunol, 164: 6057-6066 (2000).
Baylin, DNA methylation and gene silencing in cancer, Nat Clin Pract Oncol 2, Suppl 1, S4-11 (2005).
Beck et al., "Enterocolitis in Patients With Cancer After Antibody Blockade of Cytotoxicity TLymphocyte-Associated Antigen 4," J Clin Oncol, 24(15): 2283-2289 (2006).
Behrends et al., Network organization of the human autophagy system, Nature, 466(7302):68-76 (2010).

Bellucci et al., "Complete Response to Donor Lymphocyte Infusion in Multiple Myeloma is Associated with Antibody Responses to Highly Expressed Antigens," Blood, 103: 656-663 (2004).
Benson, Tandem repeats finder: a program to analyze DNA sequences, Nucleic acids research, 27(2):573-580 (1999).
Bentley et al., "Accurate Whole Human Genome Sequencing using Reversible Terminator Chemistry," Nature, 456(7218): 53-59 (2008).
Benton et al., Screening lambdagt recombinant clones by hybridization to single plaques in situ, Science, 196(4286):180-182 (1977).
Berg et al., Detection of artifacts and peptide modifications in liquid chromatography/mass spectrometry data using two-dimensional signal intensity map data visualization, Rapid Commun Mass Spectrom, 20(10):1558-1562 (2006).
Berger et al., Melanoma genome sequencing reveals frequent PREX2 mutations, Nature, 485(7399):502 (2012).
Berman et al., Regions of focal DNA hypermethylation and long-range hypomethylation in colorectal cancer coincide with nuclear lamina-associated domains, Nat Genet, 44:40-46 (2012).
Bettelli et al., "TH-17 cells in the circle of immunity and autoimmunity," Nat Immunol, 8:345-350 (2007).
Bhardwaj et al., "TLR Agonists: Are They Good Adjuvants?," Cancer J, 16:382-391 (2010).
Bindea et al., Spatiotemporal dynamics of intratumoral immune cells reveal the immune landscape in human cancer, Immunity, 39:782-795 (2013).
Bird, DNA methylation patterns and epigenetic memory, Genes Dev, 16:6-21 (2002).
Birrell et al., A genome-wide screen in Saccharomyces cerevisiae for genes affecting UV radiation sensitivity, Proceedings of the National Academy of Sciences 98(22):12608-12613 (2001).
Bishop et al., APOBEC-mediated editing of viral RNA, Science, 305:645 (2004).
Bisht et al., "Severe acute respiratory syndrome coronavirus spike protein expressed by attenuated vaccinia virus protectively immunizes mice," Proc Natl Acad Sci, 101:6641-46 (2004).
Blanchard et al., "Modified vaccinia virus Ankara undergoes limited replication in human cells and lacks several immunomodulatory proteins: implications for use as a human vaccine," Journal of General Virology, 79(5):1159-1167 (1998).
Bock et al., BiQ Analyzer: visualization and quality control for DNA methylation data from bisulfite sequencing, Bioinformatics, 21:4067-4068 (2005).
Boen et al., Identification of T Cell Ligands in a Library of Peptides Covalently Attached to HLA-DR4, J Immunol, 165:2040-2047 (2000).
Bogunovic et al., TLR4 engagement during TLR3-induced proinflammatory signaling in dendritic cells promotes IL-10-mediated suppression of antitumor immunity, Cancer Res, 71(16):5467-5476 (2011).
Bohm et al., DNA vector constructs that prime hepatitis B surface antigen-specific cytotoxic T lymphocyte and antibody responses in mice after intramuscular injection. Journal of immunological methods 193(1): 29-40 (1996).
Boisgerault et al., Definition of the HLA-A29 peptide ligand motif allows prediction of potential T-cell epitopes from the retinal soluble antigen, a candidate autoantigen in birdshot retinopathy, PNAS, 93:3466-3470 (1996).
Boisguerin et al., "Translation of genomis-guided RNA-based personalised cancer vaccaines: towards the bedside," British J Cancer, 111:1469-1475 (2014).
Boller et al. Characterization of the antibody response specific for the human endogenous retrovirus HTDV/HERV-K, Journal of virology, 71(6):4581-4588 (1997).
Boni et al. "Adoptive transfer of allogeneic tumor-specific T cells mediates effective regression of large tumors across major histocompatibility barriers," Blood, 112(12):4746-4754 (2008).
Boon et al., "Human T Cell Responses Against Melanoma," Annu Rev Immunol, 24: 175-208 (2006).
Boon, "Toward a Genetic Analysis of Tumor Rejection Antigens," Adv Cancer Res, 58:177-210 (1992).

(56) References Cited

OTHER PUBLICATIONS

Boquest et al., Isolation and transcription profiling of purified uncultured human stromal stem cells: alteration of gene expression after in vitro cell culture, Molecular biology of the cell, 16(3):1131-1141 (2005).
Boscardin et al., "Antigen targeting to dendritic cells elicits long-lived T cell help for antibody responses," Journal of Experimental Medicine, 203(3):599-606 (2006).
Bourdetsky et al., The nature and extent of contributions by defective ribosome products to the HLA peptidome, PNAS, III, E1591-E1599 (2014).
Bowerman et al., "Engineering the binding properties of the T cell receptor:peptide:MHC ternary complex that governs T cell activity," Mol Immunol, 46(15):3000-3008 (2009).
Boyle et al., "Gel-free multiplexed reduced representation bisulfite sequencing for large-scale DNA methylation profiling," Genome Biol, 13:R92 (2012).
Bozic et al., Dynamics of targeted cancer therapy, Trends Mol Med, 18:311-316 (2012).
Bozic et al., Evolutionary dynamics of cancer in response to targeted combination therapy, Elife, 2:e00747 (2013).
Brahmer et al. Safety and activity of anti-PD-L1 antibody in patients with advanced cancer. N Engl J Med 366(26):2455-2465 (2012).
Brandle et al., "A Mutated HLA-A2 Molecule Recognized by Autologous Cytotoxic T Lymphocytes on a Human Renal Cell Carcinoma," J Exp Med, 183: 2501-2508 (1996).
Bremel et al., An integrated approach to epitope analysis I: Dimensional reduction, visualization and prediction of MHC binding using amino acid principal components and regression approaches, Immunome Res, 6:7 (2010).
Brinckerhoff et al., "Melanoma Vaccines," Curr Opin Oncol, 12:163-173 (2000).
Broad Institute Article, Jan. 29, 2009, "Turning Cancer's Strength Into Weakness," (2009).
Brochier et al., "Large-scale eradication of rabies using recombinant vaccinia-rabies vaccine," Nature, 354:520-552 (1991).
Brown et al., Integrative genomic analysis implicates gain of PIK3CA at 3g26 and MYC at 8q24 in chronic lymphocytic leukemia, Clin Cancer Res, 8:3791-802 (2012).
Brunsvig et al., "Telomerase Peptide Vaccination: A Phase I/II Study in Patients with Non-Small Cell Lung Cancer," Cancer Immunol Immunother, 55(12): 1553-1564 (2006).
Buchschacher et al., "Human immunodeficiency virus vectors for inducible expression of foreign genes." Journal of virology, 66(5):2731-2739 (1992).
Buckwalter et al., "'It is the antigen(s), stupid' and other lessons from over a decade of vaccitherapy of human cancer," Seminar in Immunology, 20(5):296-300 (2008).
Buller et al., "Decreased virulence of recombinant vaccinia virus expression vectors is associated with a thymidine kinase-negative phenotype," Nature, 317:813-815 (1985).
Buller et al., "Deletion of the vaccinia virus growth factor gene reduces virus virulence," Journal of virology, 62(3):866-874 (1988).
Burger et al., "Safety and activity of ibrutinib plus rituximab for patients with high-risk chronic lymphocytic leukaemia: a single-arm, phase 2 study," Lancet Oncology, 15(10):1090-1099 (2014).
Burger et al., B cell receptor signaling in chronic lymphocytic leukemia, Trends Immunol, 34:592-601 (2013).
Burkhardt et al., Autologous CLL cell vaccination early after transplant induces leukemia-specific T cells, The Journal of clinical investigation, 123(9):3756-3765 (2013).
Buser et al., Unique composite hematolymphoid tumor consisting of a pro-T lymphoblastic lymphoma and an indeterminate dendritic cell tumor: evidence for divergent common progenitor cell differentiation, Pathobiology, 81:199-205 (2014).
Byrd et al., Targeting BTK with ibrutinib in relapsed chronic lymphocytic leukemia, The New England journal of medicine, 369:32-42 (2013).
Bystryn et al., Double-blind trial of a polyvalent, shed-antigen, melanoma vaccine, Clin Cancer Res, 7(7):1882-1887 (2001).
Cahill et al., 450K-array analysis of chronic lymphocytic leukemia cells reveals global DNA methylation to be relatively stable over time and similar in resting and proliferative compartments, Leukemia, 27:150-158 (2013).
Cai et al., "Peptides Derived From Mutated BCR-ABL Elicit T Cell Immunity In CML Patients," Blood, 116(21): 388-388 (2010).
Cancer Genome Atlas Network, Comprehensive molecular portraits of human breast tumours, Nature, 490:61-70 (2012).
Cancer Genome Atlas Research Network, Comprehensive genomic characterization defines human glioblastoma genes and core pathways, Nature, 455(7216):1061-1068 (2008).
Cancer Genome Atlas Research Network, Comprehensive molecular characterization of clear cell renal cell carcinoma, Nature, 499:43-49 (2013).
Cancer Genome Atlas Research Network, Comprehensive molecular characterization of gastric adenocarcinoma, Nature, 513:202-209 (2014).
Cancer Genome Atlas Research Network, Integrated genomic analyses of ovarian carcinoma, Nature, 474: 609-615 (2011).
"Carbone, et al., "Immunization with mutant p53-and-K-ras-derived peptides in cancer patients: immune response and clinical outcome" Journal of Clinical Oncology, (2005) 23(22): 5099-5107".
Carithers, L.J..,et al. (2015). A Novel Approach to High-Quality Postmortem Tissue Procurement: The GTEx Project. Biopreservation Biobanking 13, 311-319.
Caron et al., Analysis of MHC immunopeptidomes using mass spectrometry, Mol Cell Proteomics (2015), doi: 10.1074/mcp.0115.052431.
Carpten et al., "A transforming mutation in the pleckstrin homology domain of AKT1 in cancer," Nature, 448(26):439-444 (2004).
Carreno et al., A dendritic cell vaccine increases the breadth and diversity of melanoma neoantigen-specific T cells, Science, 348(6239):803-808 (2015).
Carreno et al., "IL-12p70-producing patient DC vaccine elicits Tc1-polarized immunity," Journal of Clinical Investigation, 123(8):3383-94 (2013).
Carter et al., Absolute quantification of somatic DNA alterations in human cancer, Nat Biotechnol, 30:413-21 (2012).
Carter et al., Accurate estimation of homologue-specific DNA concentration-ratios in cancer samples allows long-range haplotyping, Nature Precedings, 59-87 (2011).
Caskey et al., "Synthetic double-stranded RNA induces innate immune responses similar to a live viral vaccine in humans," The Journal of experimental medicine, 208(12):2357-2366 (2011).
Castle et al., Exploiting the mutanome for tumor vaccination, Cancer research, 72(5):1081-1091 (2012).
CBOL Plant Working Group, A DNA barcode for land plants, PNAS, 106(31):12794-12797 (2009).
Certified Priority Document for U.S. Appl. No. 61/334,866, filed May 14, 2010.
Chang et al., Immune selection of hot-spot beta 2-microglobulin gene mutations, HLA-A2 allospecificity loss, and antigen-processing machinery component down-regulation in melanoma cells derived from recurrent metastases following immunotherapy, Journal of immunology, 174:1462-1471 (2005).
Chang et al., "Peptide length-based prediction of peptide-MHC class II binding," Bioinformatics, 22(22): 2761-2767 (2006).
Chapman et al., Initial genome sequencing and analysis of multiple myeloma, Nature, 471:467-472 (2011).
Chatila, "The Regulatory T Cell Transcriptosome: E Pluribus Unum," Immunity, 27(5):693-695 (2007).
Cheever, Twelve immunotherapy drugs that could cure cancers, Immunological reviews, 222:357-368 (2008).
Chen, et al. "Hotspot mutations delineating diverse mutational signatures and biological utilities across cancer types," BMC Cenomics (2016)17(Suppl 2):394.
Chen et al., Impact of replication timing on non-CpG and CpG substitution rates in mammalian genomes, Genome Res, 20:447-457 (2010).
Chen et al., "Langerhans Cell Sarcoma Arising from Chronic Lymphocytic Lymphoma/Small Lymphocytic Leukemia: Lineage Analysis and BRAF V600E Mutation Study," N Am J Sci, 5:386-91 (2013).

(56) References Cited

OTHER PUBLICATIONS

Chen et al., Molecular mechanisms of T cell co-stimulation and co-inhibition, Nature reviews Immunology, 13:227-242 (2013).
Chen et al., Molecular Pharmaceutics, 3:109-111 (2010).
Chen et al., "Recombinant modified vaccinia virus Ankara expressing the spike glycoprotein of severe acute respiratory syndrome coronavirus induces protective neutralizing antibodies primarily targeting the receptor binding region," Journal of virology, 79.5:2678-2688 (2005).
Chianese-Bullock et al., "Multi-peptide vaccines vialed as peptide mixtures can be stable reagents for use in peptide-based immune therapies," Vaccine, 27(11):1764-1770 (2009).
Chiari et al., "Two Antigens Recognized by Autologous Cytolytic T Lymphocytes on a Melanoma Result from a Single Point Mutation in an Essential Housekeeping Gene," Cancer Res, 59: 5785-5792 (1999).
Child et al., "Insertional inactivation of the large subunit of ribonucleotide reductase encoded by vaccinia virus is associated with reduced virulence in vivo," Virology, 174(2):625-629 (1990).
Chim et al., Epigenetic dysregulation of the Wnt signalling pathway in chronic lymphocytic leukaemia, J Clin Pathol, 61:1214-1219 (2008).
Chiron et al., Cell-cycle reprogramming for P13K inhibition overrides a relapse-specific C4815 Btk mutation revealed by longitudinal functional genomics in mantle cell lymphoma, Cancer Discov, 4:1022-35 (2014).
Chowell et al., TCR contact residue hydrophobicity is a hallmark of immunogenic CD8(+) T cell epitopes, PNAS, 112:E1754-E1762 (2015).
Christian et al., Targeting DNA double-strand breaks with TAL effector nucleases, Genetics, 186(2):757-761 (2010).
Christianson et al., Defining human ERAD networks through an integrative mapping strategy, Nat Cell Biol, 14:93-105 (2012).
Chroboczek et al., "The Sequence of the Genome of Adenovirus Type 5 and Its Comparison with the Genome of Adenovirus Type 2," Virology, 186:280-285 (1992).
Church, Genomes for all, Sci Am, 294(1):46-54 (2006).
Cibulskis et al., ContEst: estimating cross-contamination of human samples in next-generation sequencing data, Bioinformatics, 27:2601-2602 (2011).
Cibulskis et al. Sensitive detection of somatic point mutations in impure and heterogenous cencer samples. Nat Biotechnol 31:213-219 (2013).
Ciofani et al., "A Validated Regulatory Network for Th17 Cell Specification," Cell, 151(2):289-303 (2012).
Cleveland, Lowess: A program for smoothing scatterplots by robust locally weighted regression, The American Statistician, 35:54 (1981).
Clinical trial NCT 01970358, Patrick Ott, A Phase I Study With a Personalized NeoAntigen Cancer Vaccine in Melanoma, p. 1-6, Retrieved from https://clinicaltrials.gov/ct2/show/NCT01970358 downloaded Jun. 20, 2017.
Coffman et al., "Vaccine Adjuvants: Putting Innate Immunity to Work," Immunity 33:492-503 (2010).
Conlon et al., "Mouse, but not Human STING, Binds and Signals in Response to the Vascular Disrupting Agent 5,6-Dimethylxanthenone-4-Acetic Acid," Journal of Immunology, 190:5216-25 (2013).
Corbett et al., "Aerosol immunization with NYVAC and MVA vectored vaccines is safe, simple, and immunogenic," Proc Natl Acad Sci, 105(6):2046-51 (2008).
Coulie et al., A mutated intron sequence codes for an antigenic peptide recognized by cytolytic T lymphocytes on a human melanoma, Proc Natl Acad Sci USA, 92(17):7976-7980 (1995).
Cox et al., "Induction of cytotoxic T lymphocytes by recombinant canarypox (ALVAC) and attenuated vaccinia (NYVAC) viruses expressing the HIV-1 envelope glycoprotein," Virology, 195(2):845-850 (1993).
Crozat et al., "The XC chemokine receptor 1 is a conserved selective marker of mammalian cells homologous to mouse CD8a+ dendritic cells," Journal of Experimental Medicine, 207(6):1283-1292 (2010).

CT-011 and p53 Genetic Vaccine for Advance Solid Tumor, National Library of Medicine, updated:2011_06_30, XP002738554.
Daheshia et al., "Suppression of ongoing ocular inflammatory disease by topical administration of plasmid DNA encoding IL-10," The Journal of Immunology 159(4):1945-1952 (1997).
De et al., Aberration in DNA methylation in B-cell lymphomas has a complex origin and increases with disease severity, PLoS Genet. 9:e1003137 (2013).
De Magalhaes et al., Next-generation sequencing in aging research: emerging applications, problems, pitfalls and possible solutions, Ageing Research Reviews, 9(3):315-323 (2010).
DeLuca et al., RNA-SeQC: RNA-seq metrics for quality control and process optimization, Bioinformatics, 28:1530-2 (2012).
Depristo et al. A framework for variation discovery and genotyping using next generation DNA sequencing data. Nat Genetics 43:491-498 (2011).
Di Stasi et al., "Inducible apoptosis as a safety switch for adoptive cell therapy," New England Journal of Medicine, 365(18):1673-1683 (2011).
Didierlaurent et al., "Attenuated poxviruses expressing a synthetic HIV protein Stimulate HLA-A2-restricted cytotoxic T-cell responses," Vaccine, 22(25-26):3395-3403 (2004).
Dohner et al., Genomic aberrations and survival in chronic lymphocytic leukemia, The New England journal of medicine, 343:1910-1916 (2000).
Doody et al., "PRDMI/BLIMP-1 Modulates IFN--Dependent Control of the MHC Class I Antigen-Processing and Peptide-Loading Pathway," The Journal of Immunology, 179:7614-7623 (2007).
Dossinger et al., MHC multimer-guided and cell culture-independent isolation of functional T cell receptors from single cells facilitates TCR identification for immunotherapy, PloS one, 8(4):e61384 (2013).
Dreicer et al., "MVA-MUC1-IL2 vaccine immunotherapy (TG4010) improves PSA doubling time in patients with prostate cancer with biochemical failure," Investigational new drugs, 27(4):379-386 (2009).
Dubey et al., The immunodominant antigen of an ultraviolet-induced regressor tumor is generated by a somatic point mutation in the Dead (SEQ ID No. 62) box helicase p68, The Journal of experimental medicine, 185(4):695-705 (1997).
DuPage et al., "Expression of tumour-specific antigens underlies cancer immunoediting," Nature, 482(7385):405-409 (2012).
Dupuis et al., "Dendritic Cells Internalize Vaccine Adjuvant after Intramuscular Injection," Cell Immunol, 186(1): 18-27 (1998).
Earl et al., "Immunogenicity of a highly attenuated MVA smallpox vaccine and protection against monkeypox," Nature, 428:182 (2004).
Eckhardt et al., DNA methylation profiling of human chromosomes 6, 20 and 22, Nat Genet, 38:1378-1385 (2006).
Eden et al., GOrilla: a tool for discovery and visualization of enriched GO terms in ranked gene lists, BMCBioinformatics, 10:48 (2009).
"Efremova, et al., "Neoantigens Generated By Individual Mutations And Their Role in Cancer Immunitya nd Immunotherapy" Frontiers in Immunology (2017) vol. 8, pp. 1-8".
Eggermont et al., Ulceration and stage are predictive of interferon efficacy in melanoma: results of the phase III adjuvant trials EORTC 18952 and EORTC 18991, EurJ Cancer, 48(2):218-225 (2012).
Eichmann et al., Identification and characterisation of peptide binding motifs of six autoimmune disease-associated human leukocyte antigen-class I molecules including HLA-B*39:06, Tissue Antigens 84(4):378-388 (2014).
Elias et al., Target-decoy search strategy for increased confidence in large-scale protein identifications by mass spectrometry, Nat Meth, 4:207-214 (2007).
Engelhard, "Structure of peptides associated with MHC class I molecules," Curr Opin Immunol, 6(1):13-23 (1994).
Engler et al., A one pot, one step, precision cloning method with high throughput capability, PloS one 3(11):e3647 (2008).
Engler et al., Golden gate shuffling: a one-pot DNA shuffling method based on type IIs restriction enzymes, PloS one, 4(5):e5553 (2009).
Erlich et al., "Next-generation sequencing for HLA typing of class I loci," BMC Genomics, 12:42 (2011).

(56) References Cited

OTHER PUBLICATIONS

Escobar et al., Bayesian density estimation and inference using mixtures, Journal of the American Statistical Association, 90:577-588 (1995).
Esteban, "Attenuated poxvirus vectors MVA and NYVAC as promising vaccine cadidates against HIV/AIDS," Human vaccines, 5(12):867-871 (2009).
Estep et al., "Mutation Analysis of BRAF, MEK1 and MEK2 in 15 Ovarian Cancer Cell Lines: Implications for Therapy," PLOS ONE, 12:e1279 (2007).
Extended European Search Report received for EP patent application No. EP11781409, mailed Apr. 10, 2014.
Eyers et al., CONSeQuence: prediction of reference peptides for absolute quantitative proteomics using consensus machine learning approaches, Mol Cell Proteomics (2011); 10(11):M110.003384. doi: 10.1074/mcp.MI 10.003384. Epub Aug. 3, 2011.
Ezzell, "Cancer 'Vaccines': An idea whose time has come?," J NIH Res, 7:46 (1995).
Fais et al., Chronic lymphocytic leukemia B cells express restricted sets of mutated and unmutated antigen receptors, The Journal of clinical investigation, 102:1515-25 (1998).
Fan et al., The multi substrate adapter Gabl regulates hepatocyte growth factor (scatter factor)-c-Met signaling for cell survival and DNA repair, Molecular and Cellular Biology, 21:4968-4984 (2001).
Fantom Consortium et al., A promoter-level mammalian expression atlas, Nature, 507:462-470 (2014).
Farsaci et al., Consequence of dose scheduling of sunitinib on host immune response elements and vaccine combination therapy, Int J Cancer, 130:1948-1959 (2012).
Feigner et al., Lipofection: a highly efficient, lipid-mediated DNA-transfection procedure, PNAS, 84(21):7413-7414 (1987).
Feng, Du et al., The Significance and Therapeutic Potential of GATA3 Expression and Mutation in Breast Cancer: A Systematic Review, Medicinal Research Reviews, vol. 35, No. 6, Nov. 1, 1015, PP-1300-1315, XP002791786.
Ferrier-Rembert et al., Short-and long-term immunogenicity and protection induced by non-replicating smallpox vaccine candidates in mice and comparison with the traditional 1st generation vaccine, Vaccine, 26(14):1794-1804 (2008).
Final Rejection for U.S. Appl. No. 15/187,174, Compositions and Methods of Identifying Tumor Specific Neoantigens, dated Oct. 12, 2018.
Finke et al., Sunitinib Reverses Type-1 Immune Suppression and Decreases T-Regulatory Cells in Renal Cell Carcinoma Patients, Clin Cancer Res, 14(20):6674-6682 (2008).
Fisher et al., A scalable, fully automated process for construction of sequence-ready human exome targeted capture libraries, Genome Biol, 12:R1 (2011).
Flaherty et al., From genes to drugs: targeted strategies for melanoma, Nat Rev Cancer, 12(5):349-361 (2012).
Flexner et al., "Prevention of vaccinia virus infection in imiminodeficient mice by vector-directed IL-2 expression," Nature, 330(6145):259-262 (1987).
Flynn et al., Immunization with HIV Gag targeted to dendritic cells followed by recombinant New York vaccinia virus induces robust T-cell immunity in nonhuman primates, Proc Natl Acad Sci, 108(17):7131-7136 (2011).
Forconi et al., Genome-wide DNA analysis identifies recurrent imbalances predicting outcome in chronic lymphocytic leukaemia with 17p deletion, British journal of haematology, 143:532-6 (2008).
Fransen et al., Controlled local delivery of CTLA-4 blocking antibody induces CD8+ T-cell-dependent tumor eradication and decreases risk of toxic side effects, Clin Cancer Res, 19(19):5381-5389 (2013).
Frederick et al., "BRAF inhibition is associated with enhanced melanoma antigen expression and a more favorable tumor microenvironment in patients with metastatic melanoma," Clin Cancer Res, 19:1225-1231 (2013).
Friedberg et al., Inhibition of Syk with fostamatinib disodium has significant clinical activity in non-Hodgkin lymphoma and chronic lymphocytic leukemia, Blood, 115:2578-2585 (2011).
Fritsch, Edward F. et al., HLA-binding properties of tumor neoepitopes in humans, Cancer Immunology Research, Jun. 2014, vol. 2, No. 6, Jun. 2014, pp. 522-529.
Fritsch et al., "Personal neoantigen cancer vaccines: The momentum builds," Oncoimmunology, 3(6):e29311 (2014).
Fruci et al., Altered expression of endoplasmic reticulum aminopeptidases ERAPI and ERAP2 in transformed non-lymphoid human tissues, J Cell Physiol, 216(3):742-749 (2008).
Furman et al., Ibrutinib resistance in chronic lymphocytic leukemia, The New England journal of medicine, 370(24):2352 (2014).
Fynan et al., "DNA vaccines: protective immunizations by parenteral, mucosal, and gene-gun inoculations," PNAS, 90 (24): 11478-82 (1993).
Gabrilovich, et al., "IL-12 and Mutant P53 Peptide-Pulsed Dendritic Cells for the Specific Immunotherapy of Cancer," J Immunother Emphasis Tumor Immunol, 19(6): 414-418 (1997).
Gallego-Gomez et al., "Differences in virus-induced cell morphology and in virus maturation between MVA and other strains (WR, Ankara, and NYCBH) of vaccinia virus in infected human cells," Journal of virology, 77(19):10606-10622 (2003).
Gallois et al., A needle in the 'cancer vaccine' haystack, Nature medicine, 16(8):854-856 (2010).
Gao et al., Integrative analysis of complex cancer genomics and clinical profiles using the cBioPortal, Science signaling, 6(269):pi1 (2013).
Garimella et al., Identification of novel molecular regulators of tumor necrosis factor-related apoptosis-inducing ligand (TRAIL)-induced apoptosis in breast cancer cells by RNAi screening, Breast cancer research, 16(2):R41 (2014).
Garofalo et al., miR-221&222 regulate TRAIL resistance and enhance tumorigenicity through PTEN and TIMP3 downregulation, Cancer Cell, 16(6):498-509 (2009).
Garraway et al., Lessons from the cancer genome, Cell, 153:17-37 (2013).
Gaucher et al., Yellow fever vaccine induces integrated multilineage and polyfunctional immune responses, The Journal of experimental medicine, 205(13):3119-3131 (2008).
Gazdar, Activating and resistance mutations of EGFR in non-small-cell lung cancer: role in clinical response to EGFR tyrosine kinase inhibitors, Oncogene, 28:S24-S31 (2009).
Gherardi et al., Prime-boost immunization schedules based on influenza virus and vaccinia virus vectors potentiate cellular immune responses against human immunodeficiency virus Env protein systemically and in the genitorectal draining lymph nodes, Journal of virology, 77(12):7048-7057 (2003).
Ghiringhelli et al., "Metronomic cyclophosphamide regimen selectively depletes CD4+CD25+ regulatory T cells and restores T and NK effector functions in end stage cancer patients," Cancer Immunol Immunother, 56:641-648 (2007).
Giaever et al., Functional profiling of the *Saccharomyces cerevisiae* genome, Nature, 418(6896):387-391 (2002).
Giannopoulos et al., Peptide vaccination elicits leukemia-associated antigen-specific cytotoxic CD8+ T-cell responses in patients with chronic lymphocytic leukemia, Leukemia, 24(4):798-805 (2010).
Gibbs et al., Abundant quantitative trait loci exist for DNA methylation and gene expression in human brain, PLoS genetics, 6:e1000952 (2010).
Gibney et al., "Safety and efficacy of adjuvant anti-PD1 therapy (nivolumab) in combination with vaccine in resected high-risk metastatic melanoma.," J Clin Oncol, Abstract 9056 (2013).
Gilboa, "The Makings of a Tumor Rejection Antigen," Immunity, 11: 263-270 (1999).
"Gjertsen, et al., "Cytotoxic CD4+ and CD8+ T Lymphocytes, Generated by Mutant p21-ras (12VAL) peptide vaccination of a patient, recognize 12val-dependent nested epitopes present within the vaccine peptide and kill autologous tumour cells carrying this mutation" Int. J. Cancer (1997) 72, 784-790".
"Gjertsen, et al., "Intradermal RAS Peptide vaccination with granulocyte-macrophage colony-stimulating factor as adjuvant: clinical and

(56) References Cited

OTHER PUBLICATIONS immunological responses in patients with pancreatic adenocarcinoma" Int. J. Cancer: (2001) 92, 441-450".
Gluzman, Yakov, SV40-transformed simian cells support the replication of early SV40 mutants, Cell, 23:175-182 (1981).
Gnirke et al., "Solution Hybrid Selection with Ultra-Long Oligonucleotides for Massively Parallel Targeted Sequencing," Nat Biotechnol, 27(2): 182-189 (2009).
Goebel et al., "The complete DNA sequence of vaccinia virus," Virology, 179(1):247-266 (1990).
Gomez et al., "Efficient CD8+ T cell response to the HIV-env V3 loop epitope from multiple virus isolates by a DNA prime/vaccinia virus boost (rWR and rMVA strains) immunization regime and enhancement by the cytokine IFN-y," Virus research, 105:11-22 (2004).
Gomez et al., Head-to-head comparison on the immunogenicity of two HIV/AIDS vaccine candidates based on the attenuated poxvirus strains MVA and NYVAC co-expressing in a single locus the HIV-1 BX08 gp120 and HIV-111IB Gag-Pol-Nef proteins of Glade B, Vaccine, 25(15):2863-2885 (2007).
Gomez et al., MVA and NYVAC as vaccines against emergent infectious diseases and cancer, Current gene therapy, 11(:3):189-217 (2011).
Gomez et al., The poxvirus vectors MVA and NYVAC as gene delivery systems for vaccination against infectious diseases and cancer, Current gene therapy, 8(2):97-120 (2008).
Gomez et al., Virus distribution of the attenuated MVA and NYVAC poxvirus strains in mice, Journal of General Virology, 88(9):2473-2478 (2007).
Gotter et al., "Medullary Epithelial Cells of the Human Thymus Express a Highly Diverse Selection of Tissue-specific Genes Colocalized in Chromosomal Clusters," J Exp Med, 199(2): 155-166 (2004).
Goya et al., "SNVMix:predicting single nucleotide variants from next-generation sequencing of tumors," Bioinformatics, Original Paper, 26(6): 730-736 (2010).
Greco et al., Improving the safety of cell therapy with the TK-suicide gene, Front Pharmacol, 6:95 (2015).
Greenman et al., Patterns of somatic mutation in human cancer genomes, Nature, 446:153-158 (2007).
Gregoriadis et al., "Improving the therapeutic efficacy of peptides and proteins: A role for polysialic acids," Int J Pharmaceutics, 300(1-2):125-30 (2005).
Gros et al. PD-1 identifies the patient-specific CD8+ tumor-reactive repertoire infiltrating human tumors. The Journal of clinical investigation, 124(5):2246-2259 (2014).
Grunstein et al., Colony hybridization: a method for the isolation of cloned DNAs that contain a specific gene, PNAS, 72(10):3961-3965 (1975).
Gubin et al., Checkpoint blockade cancer immunotherapy targets tumor-specific mutant antigens, Nature, 515:577-581 (2014).
Gueguen et al., An Antigen Recognized by Autologous CTLs on a Human Bladder Carcinoma, J Immunol, 160(12): 6188-6194 (1998).
Guo et al., Different length peptids bind to HLA-Aw68 similarity at their ends but bulge on in the middle, Nature, 360:364-366 (1992).
Guruprasad et al., Correlation between stability of a protein and its dipeptide composition: a novel approach for predicting in vivo stability of a protein from its primary sequence, Protein Eng, 4(2):155-161 (1990).
Gustin, et al. GATA3 frameshift mutation promotes tumor grouwth in human luminal breast cancer cells and induces transcriptional changes seen in primary GATA3 mutant breast cancers, Oncotarget, 2017, vol. 8, (No. 61), pp. 103415-103427.
Guthals et al., Shotgun Protein Sequencing with Meta-contig Assembly, Molecular and Cellular Proteomics, 1(10):1084-96 (2012).
Hoof, et al. NetMHCpan, a method for MHC class I binding prediction beyond humans. Immunogenetics. 61.1 (2009):1-13. doi: 10.1007/s00251-008-0341-z. Epub Nov. 12, 2008.

Huang et al., "Mucosal priming with replicative Tiantan vaccinia and systemic boosting with DNA vaccine raised strong mucosal and systemic HIV-specific immune responses," Vaccine, 25(52):8874-8884 (2007).
Huang et al., "T Cells Associated With Tumor Regression Recognize Frameshifted Products of the CDKN2A Tumor Suppressor Gene Locus and a Mutated HLA Class | Gene Product," J Immunol, 172(10):6057-6064 (2004).
Humphries et al., "Lineage tracing reveals multipotent stem cells maintain human adenomas and the pattern of clonal expansion in tumor evolution," PNAS, 110(27):e2490-e2499 (2013).
Hunt et al., Characterization of peptides bound to the class I MHC molecule HLA-A2.1 by mass spectrometry, Science, 255:1261-1263 (1992).
Hutchings et al., "Combination of protein and viral vaccines induces potent cellular and humoral immune responses and enhanced protection from murine malaria challenge," Infect Immun, 75(12):5819-26 (2007).
Illingworth et al., Orphan CpG islands identify numerous conserved promoters in the mammalian genome, PLoS Genet, 6(9):e1001134 (2010).
Kenter et al., Vaccination against HPV-16 oncoproteins for vulvar intraepithelial neoplasia, New England Journal of Medicine, 361(19):1838-1847 (2009).
Kimmel et al., [54] Identification and characterization of specific clones: Strategy for confirming the validity of presumptive clones, Methods in enzymology, 152:507-511 (1987).
Macosko et al.: Highly Parallel Genome-wide Expression Profiling of Individual Cells Using Nanoliter Droplets. Cell. 161(5):1202-1214 (2015).
Manghera et al, Endogenous retrovirus-K promoter: a landing strip for inflammatory transcription factors?, Retrovirol, 10:16 (2013).
Marabelle et al., Depleting tumor-specific Tregs at a single site eradicates disseminated tumors, J Clin Invest, 1123(6):2447-2463(2013).
Marcais et al., A fast, lock-free approach for efficient parallel counting of occurrences of k-mers, Bioinformatics, 27(6):764-770 (2011).
Mazutis et al., Single-cell analysis and sorting using droplet-based microfluidics, Nat Protoc, 8:870-891 (2013).
McCormack et al., HLA-A*3101 and Carbamazepine-Induced Hypersensitivity Reactions in Europeans, New Engl J Med, 364:1134-1143 (2011).
McDermott et al., Immune Therapy for Kidney Cancer: A Second Dawn?, Semin Oncol, 40(4):492-498 (2013).
McFadden et al., Genetic and clonal dissection of murine small cell lung carcinoma progression by genome sequencing, Cell, 156(6):1298-1311 (2014).
McKenna et al., The Genome Analysis Toolkit: a MapReduce framework for analyzing next-generation DNA sequencing data, Genome Res, 20(9):1297-1303 (2010).
Mommen et al., "Expanding the detectable HLA peptide repertoire using electron-transfer/higher-energy collision dissociation (EThcD)," PNAS III, 4507-4512 (2014).
Mommen et al., Sampling From the Proteome to the Human Leukocyte Antigen-DR (HLA-DR) Ligandome Proceeds Via High Specificity, Mol Cell Proteomics MCP, 15:1412-1423 (2016).
Non-Final Office Action dated Jun. 27, 2019 for U.S. Appl. No. 15/575,328.
Non-Final Office Action for U.S. Appl. No. 13/108,610, Compositions and Methods of Identifying Tumor Specific Neoantigens, dated Aug. 15, 2013.
Non-Final Office Action for U.S. Appl. No. 13/108,610, Compositions and Methods of Identifying Tumor Specific Neoantigens, dated Dec. 3, 2014.
Non-Final Office Action for U.S. Appl. No. 14/794,449, Compositions and Methods of Identifying Tumor Specific Neoantigens, dated Dec. 29, 2016.
Non-Final Office Action for U.S. Appl. No. 14/794,449, "Compositions and Methods of Identifying Tumor Specific Neoantigens," dated Jul. 24, 2018.

(56) References Cited

OTHER PUBLICATIONS

Non-Final Office Action for U.S. Appl. No. 14/877,125, Compositions and Methods for Personalized Neoplasia Vaccines, dated Mar. 27, 2017.
Non-Final Office Action for U.S. Appl. No. 14/877,125, "Compositions and Methods for Personalized Neoplasia Vaccines," dated Nov. 2, 2018.
Non-Final Office Action for U.S. Appl. No. 15/038,504, Compositions and Methods for Diagnosing, Evaluating and Treating Cancer by Means of the DNA Methyl, dated Sep. 6, 2017.
Non-Final Office Action for U.S. Appl. No. 15/102,129, Formulations for Neoplasia Vaccines, dated Dec. 17, 2018.
Non-Final Office Action for U.S. Appl, No. 15/102,129, Formulations for Neoplasia Vaccines, dated Jul. 28, 2017.
Non-Final Office Action for U.S. Appl. No. 15/102,129, Formulations for Neoplasia Vaccines, dated Mar. 7, 2018.
Non-Final Office Action for U.S. Appl. No. 15/105,961, Combination Therapy With Neoantigen Vaccine, dated Jan. 8, 2019.
Non-Final Office Action for U.S. Appl. No. 15/105,961, Combination Therapy With Neoantigen Vaccine, dated Nov. 20, 2017.
Non-Final Office Action for U.S. Appl. No. 15/187,174, "Compositions and Methods of Identifying Tumor Specific Neoantigens," dated Dec. 5, 2016.
Non-Final Office Action for U.S. Appl. No. 15/187,174, Compositions and Methods of Identifying Tumor Specific Neoantigens, dated Jan. 22, 2018.
Non-Final Office Action for U.S. Appl. No. 15/513,127, Use of Clonal Evolution Analysis for Ibrutinib Resistance in Chronic Lymphocytic Leukemia Patients, dated Nov. 26, 2018.
Non-Final Office Action for U.S. Appl. No. 15/537,785, Methods for Profiling the T Cell Repertoire, dated Dec. 21, 2018.
Non-Final Office Action for U.S. Appl. No. 16/181,098, Compositions and Methods of Identifying Tumor Specific Neoantigens, dated Jan. 31, 2019.
Notice of Allowance for U.S. Appl. No. 13/108,610, Compositions and Methods of Identifying Tumor Specific Neoantigens, mailed Jun. 11, 2015.
Notice of Allowance for U.S. Appl. No. 13/108,610, Compositions and Methods of Identifying Tumor Specific Neoantigens, mailed May 12, 2015.
Notice of Allowance for U.S. Appl. No. 15/102,129, Formulations for Neoplasia Vaccines, mailed Oct. 12, 2018.
Peitras, Richard J., Biologic Basis of Sequential and Combination Therapies for Hormone-Response Breast Cancer, The Oncologist, 2006; 11:704-717.
Restriction Requirement for U.S. Appl. No. 13/108,610, Compositions and Methods of Identifying Tumor Specific Neoantigens, dated Mar. 7, 2013.
Restriction Requirement for U.S. Appl. No. 14/794,449, Compositions and Methods of Identifying Tumor Specific Neoantigens, dated Oct. 26, 2016.
Restriction Requirement for U.S. Appl. No. 14/877,125, Compositions and Methods for Personalized Neoplasia Vaccines, dated Nov. 18, 2016.
Restriction Requirement for U.S. Appl. No. 15/038,504, Compositions and Methods for Diagnosing, Evaluating and Treating Cancer By Means of the Dna Methyl, dated Jun. 22, 2017.
Restriction Requirement for U.S. Appl. No. 15/102,129, Formulations for Neoplasia Vaccines, dated May 8, 2017.
Restriction Requirement for U.S. Appl. No. 15/105,961, Combination Therapy With Neoantigen Vaccine, dated Jul. 13, 2017.
Restriction Requirement for U.S. Appl. No. 15/187,174, Compositions and Methods of Identifying Tumor Specific Neoantigens, dated Sep. 9, 2016.
Restriction Requirement for U.S. Appl. No. 15/513,127, Use of Clonal Evolution Analysis for Ibrutinib Resistance in Chronic Lymphocytic Leukemia Patients, dated Aug. 13, 2018.
Restriction Requirement for U.S. Appl. No. 15/537,785, Methods for Profiling the T Cell Repertoire, dated Mar. 22, 2018.

Restriction Requirement for U.S. Appl. No. 15/575,328, Shared Neoantigens, dated Feb. 7, 2019.
Rooney, M. et al., Molecular and genetic properties of tumors associated with local immune cytolytic activity. Cell. Jan. 15, 2015; 160(1-2): 48-61.doi: 10.1016/j.cell.2014.12.033.
Sahin et al., Personalized RNA mutanome vaccines mobilize polyspecific therapeutic immunity against cancer, Nature, 547(7662):222-226 (2017).
Saunders et al. Strelka: accurate somatic small-variant calling from sequenced tumor-normal sample pairs. Bioinformatic, 28(14):1811-1817 (2012).
Shalek et al., Single-cell RNA-seq reveals dynamic paracrine control of cellular variation, Nature, 510(7505):363-369 (2014).
Smith et al., Comparison of biosequences, Adv Appl Math, 2(4):482-489 (1981).
Subramanian et al., Gene set enrichment analysis: a knowledge-based approach for interpreting genome-wide expression profiles, PNAS, 102:15545-15550 (2005).
Takaku, et al. "GATA3 in Breat Cancer: tumor suppressor or oncogene?" HHS Public Access, 2015.
"Tan, et al., "Induction of CTLs by DCs pulsed with K-ras mutant peptide on the surface of nanoparticles in the treatment of pancreatic cancer" Oncology Reports (2011) 26: 215-221".
Teng et al., A human TAPBP (TAPASIN)-related gene, TAPBP-R, Eur J Immunol, 32:1059-1068 (2002).
Topalian et al., Safety, Activity, and Immune Correlates of Anti-PD-1 Antibody in Cancer, N Engl J Med, 366(26):2443-2454 (2012).
Topalian et al., Survival, Durable Tumor Remission, and Long-Term Safety in Patients With Advanced Melanoma Receiving Nivolumab, J Clin Oncol, 32(10):1020-1030 (2014).
"Tran, et al., "T-Cell Transfer Therapy Targeting Mutant KRAS in Cancer" N Engl J Med Dec. 8, 2016; 375(23): 2255-2262".
Van Rooij et al., Tumor exome analysis reveals neoantigen-specific T-cell reactivity in an ipilimumab-responsive melanoma, Journal of clinical oncology: official journal of the American Society of Clinical Oncology, 31:32 (2013).
Wahl et al., [43] Molecular hybridization of immobilized nucleic acids: Theoretical concepts and practical considerations, Methods in enzymology, Academic Press, 152:399-407 (1987).
Weber, et al. Assembly of Designer TAL Effectors by Golden Gate Cloning, PLoS ONE, 6:e19722 (2001).
Yoshihara, K. et al., Inferring tumour purity and stromal and immune cell admixture from expression data,: Nature communications 4:2612 (2013).
Yu et al., Nucleic acid-sensing Toll-like receptors are essential for the control of endogenous retrovirus viremia and ERV-induced tumors, Immunity, 37(5):867-879 (2012).
Yuille et al., TCL1 is activated by chromosomal rearrangement or by hypomethylation, Genes, Chromosomes and Cancer, 30(4):336-341 (2001).
Zeestraten et al., "Addition of interferon-alpha to the p53-SLP(R) vaccine results in increased production of interferon-gamma in vaccinated colorectal cancer patients: a phase 1/11 clinical trial," Int J Cancer, 132(7):1581-1591 (2013).
Zhang et al., Machine learning competition in immunology-prediction of HLA class I binding peptides, J Immunol Methods 374:1-4 (2009).
Zhang et al., Oncology, 1-44 (2005).
Zhang et al., The impact of next-generation sequencing on genomics, J Genet Genomics, 38(3):95-109 (2011).
Zhou et al., A hypermorphic missense mutation in PLCG2, encoding phospholipase Cgamma2, causes a dominantly inherited autoinflammatory disease with immunodeficiency, Am J Hum Genet, 91:713-20 (2012).
Ziller et al., Charting a dynamic DNA methylation landscape of the human genome, Nature, 500:477-481 (2013).
Zorn et al., A natural cytotoxic T cell response in a spontaneously regressing human melanoma targets a neoantigen resulting from a somatic point mutation, Eur J Immunol, 29(2):592-601 (1999).
Zwaveling et al., Established human papillomavirus type 16-expressing tumors are effectively eradicated following vaccination with long peptides, J Immunol, 169(1):350-358 (2002).

(56) References Cited

OTHER PUBLICATIONS

Abdelhakim: The activation marker CD137 identifies a highly active subset of donor lymphocytes against acute myeloid leukemia future. Biol. Blood Marrow Transplant. 25(3):290-442 (2019) Abstract.
Boyle, Louise H, et al., Tapasin-related Protein TAPBPR is an Additional Component of the MHC Class I Presentation Pathway. Proceedings of the National Academy of Sciences of the United States of America. 110(9):3465-3470 (2013).
Brown, Scott D, et al., Neo-antigens Predicted by Tumor Genome Meta-analysis Correlate With Increased Patient Survival. Genome Research 24(5):743-750 (2015).
Canadian Application No. 2,986,235 Office Action received Jul. 18, 2024.
Cancer Genome Atlas Research Network., Genomic and Epigenomic Landscapes of Adult De Novo Acute Myeloid Leukemia. The New England Journal of Medicine 368(22):2059-2074 (2013).
Carter, Paul, et al., Identification and Validation of Cell Surface Antigens for Antibody Targeting in Oncology. Endocrine-related Cancer 11(4):659-687 (2004).
Castle et al., Mutation-Derived Neoantigens for Cancer Immunotherapy. Front Immunol. Aug. 7, 2019;10:1856. doi: 10.3389/fimmu.2019.01856. PMID: 31440245; PMCID: PMC6693295.
Ceppellini.et al. Binding of labelled influenza matrix peptide to HLA DR in living B lymphoid cells. Nature 339, 392-394 (1989). https://doi.org/10.1038/339392a0.
Cerundolo et al., The binding affinity and dissociation rates of peptides for class I major histocompatibility complex molecules. Eur J Immunol. Sep. 1991;21(9):2069-75. doi: 10.1002/eji.1830210915. PMID: 1889458.
Christinck et al. Peptide binding to class I MHC on living cells and quantitation of complexes required for CTL lysis. Nature 352, 67-70 (1991). https://doi.org/10.1038/352067a0.
De Plaen, E, et al., Immunogenic (tum-) Variants of Mouse Tumor P815: Cloning of the Gene of Tum-Antigen P91A and Identification of the Tum-Mutation. Proceedings of the National Academy of Sciences of the United States of America 85(7):2274-2278 (1988).
Dengjel, Jorn, et al., Glycan Side Chains on Naturally Presented MHC Class II Ligands. Journal of Mass Spectrometry 40(1):100-104 (2005).
Dermer, Gerald B, et al., Another Anniversary for the War on Cancer. Biotechnology 12:320 (1994).
Ding, Li, et al., Genome Remodelling in a Basal-like Breast Cancer Metastasis and Xenograft. Nature 464:999-1005 (2010).
Ding, Li, et al., Somatic Mutations Affect Key Pathways in Lung Adenocarcinoma. Nature 455:1069-1075 (2008).
Eden, Eran, et al., Discovering Motifs in Ranked Lists of DNA Sequences. Plos Computational Biology 3(3):e39, 0508-0522 (2007).
EP21856745.1 Supplementary European Search Report dated Aug. 8, 2024.
Guasp, Pablo, et al., The Peptidome of Behcet's Disease-Associated HLA-B*51:01 Includes Two Subpeptidomes Differentially Shaped by Endoplasmic Reticulum Aminopeptidase 1. Arthritis & Rheumatology 68(2):505-515 (2016).
Guo, Mira T, et al., Droplet Microfluidics for High-Throughput Biological Assays. Lab on a chip 12(12):2146-2155 (2012).
Hacohen, Nir, et al., Getting Personal with Neoantigen-Based Therapeutic Cancer Vaccines. Cancer immunology research 1(1):11-15 (2013).
Hadrup, Sine Reker, et al., Parallel Detection of Antigen-Specific T-CellResponses by Multidimensional Encoding of MHC Multimers, Nature Methods, 6(7):520-526 (2009).
Halabi, Susan, et al., Prognostic Model for Predicting Survival in Men With Hormone-Refractory Metastatic Prostate Cancer. Journal of Clinical Oncology 21(7):1232-1237 (2003).
Hall, Neil., Advanced Sequencing Technologies and Their Wider Impact in Microbiology. Journal of Experimental Biology 210(9):1518-1525 (2007).
Han, Arnold, et al., Linking T-Cell Receptor Sequence to Fucntional Phenotype at the Single-Cell Level. Nature Biotechnology 32(7):684-692 (2014).
Hanahan, Douglas, et al., Hallmarks of Cancer: The Next Generation. Cell 144(5):646-674 (2011).
Hanzelmann, Sonja, et al., GSVA: Gene Set Variation Analysis for Microarray and RNA-seq Data. BMC Bioinformatics, 14:7,15 Pages (2013).
Harndahl, Mikkel, et al., Peptide-MHC Class I Stability is a Better Predictor than Peptide Affinity of CTL Immunogenicity. European Journal of Immunology 42(6):1405-1416 (2012).
Harndahl, Mikkel et al. Real-time, High-Throughput Measurements of Peptide-MHC-I Dissociation Using a Scintillation Proximity Assay. Journal of Immunological Methods vol. 374,1-2: pp. 5-12 (2011).
Hartley et al.: Pancreatic cancer, treatment options, and GI-4000. Human Vaccines & Immunotherapeutics 11(4):931-937 (2015).
Heemskerk, Bianca, et al., The Cancer Antigenome. EMBO Journal 32(2):194-203 (2013).
Herbst, Roy S, et al., Predictive Correlates of Response to the Anti-PD-L1 Antibody MPDL3280A in Cancer Patients. Nature 515(7528):563-567 (2014).
Herman, J, et al., Differences in the Recognition by CTL of Peptides Presented by the HLA-B* 4402 and the HLA-B*4403 Molecules Which Differ by a Single Amino Acid. Tissue Antigens 53(2):111-121 (1999).
Herman, S E M, et al., Ibrutinib-Induced Lymphocytosis in Patients With Chronic Lymphocytic Leukemia: Correlative Analyses From a Phase II Study. Leukemia 28(11):2188-2196 (2014).
Hersey, Peter, et al., Phase I/II Study of Treatment with Dendritic cell Vaccines in Patient with Disseminated Melanoma. Cancer Immunol Immunoother 53(2):125-134 (2004).
Hickman, Heather, et al., Toward a Definition of Self: Proteomic Evaluation of the Class I Peptide Repertoire. Journal of Immunology 172(5):2944-2952 (2004).
Hinrichs, Christian S, et al., Exploiting the Curative Potential of Adoptive T-cell Therapy for Cancer. Immunological Reviews 257(1):56-71 (2014).
Hodi, F Stephen, et al., Biologic Activity of Cytotoxic T Lymphocyte-Associated Antigen 4 Antibody Blockade in Previously Vaccinated Metastatic Melanoma and Ovarian Carcinoma Patients. Proceedings of the National Academy of Sciences of the United States of America 100(8):4712-4717 (2003).
Hodi, F Stephen, et al., Immunologic and Clinical Effects of Antibody Blockade of Cytotoxic T Lymphocyte-Associated Antigen 4 in Previously Vaccinated Cancer Patients. Proceedings of the National Academy of Sciences of the United States of America 105(8):3005-3010 (2008).
Hodi, F Stephen, et al., Improved Survival With Ipilimumab in Patients With Metastatic Melanoma. The New England Journal of Medicine 363(8):711-723 (2010).
Hombrink, Pleun, et al., High-Throughput Identification of Potential Minor Histocompatibility Antigens by MHC Tetramer-Based Screening: Feasibility and Limitations. PLoS One 6(8):e22523,11 Pages (2011).
Hombrink, Pleun, et al., Identification of Biological Relevant Minor Histocompatibility Antigens within the B-lymphocyte—Derived HLA-Ligandome Using a Reverse Immunology Approach. Clinical Cancer Research 21(9):2177-2186 (2015).
International Search Report and Written Opinion in corresponding PCT Application No. PCT/US2019/038019 dated Dec. 4, 2019.
Ishihama, Yasushi, et al., Exponentially Modified Protein Abundance Index (emPAI) for Estimation of Absolute Protein Amount in Proteomics by the Number of Sequenced Peptides Per Protein. Molecular & Cellular Proteomics 4(9):1265-1272 (2005).
Jarmalavicius, Saulius, et al., High Immunogenicity of the Human Leukocyte Antigen Peptidomes of Melanoma Tumor Cells. The Journal of Biological Chemistry 287(40):33401-33411 (2012).
Jayasinghe, Reyka G, et al., Systematic Analysis of Splice-site-creating Mutations in Cancer. Cell Reports 23(1):270-281 (2018).
Jeffery, K J, et al., The Influence of HLA Class I Alleles and Heterozygosity on the Outcome of Human T Cell Lymphotropic Virus Type I Infection. Journal of Immunology 165(12):7278-7284 (2000).

(56) References Cited

OTHER PUBLICATIONS

Johnson, Kenneth, et al., Discovery of Naturally Processed and HLA-Presented Class I Peptides from Vaccinia Virus Infection using Mass Spectrometry for Vaccine Development. Vaccine 28(1):38-47 (2009).
Jones, Philip, et al., InterProScan 5: Genome-Scale Protein Function Classification. Bioinformatics 30(9):1236-1240 (2014).
Kalaora, Shelly, et al., Use of HLA Peptidomics and Whole Exome Sequencing to Identify Human Immunogenic Neo-Antigens. Oncotarget 7(5):5110-5117 (2016).
Kandoth, Cyriac, et al., Mutational Landscape and Significance Across 12 Major Cancer Types. Nature 502(7471):333-339 (2013).
Kannan, S. et al., Vaccination Strategies in Follicular Lymphoma. Current Hematologic Malignancy Reports 4(4):189-195 (2009).
Karnani, Neerja, et al., Pan-S Replication Patterns and Chromosomal Domains Defined by Genome-Tiling Arrays of ENCODE Genomic Areas. Genome Research 17(6):865-876 (2007).
Karolchik, Donna, et al., The UCSC Table Browser Data Retrieval Tool. Nucleic Acids Research 32:D493-D496 (2004).
Kawai, Taro, et al., TLR Signaling. Seminars in Immunology 19(1):24-32 (2007).
Keskin, Derin B, et al., Neoantigen Vaccine Generates Intratumoral T Cell Responses in Phase Ib Glioblastoma Trial. Nature 565(7738):234-239 (2019).
Khong, Hung T, et al., Natural Selection of Tumor Variants in the Generation of "tumor escape" Phenotypes. Nature Immunology 3(11):999-1005 (2002).
Kim, Daehwan et al. TopHat2: Accurate Alignment of Transcriptomes in the Presence of Insertions, Deletions and Gene Fusions. Genome Biology 14:R36, 1-13 (2013).
Kim, Yohan, et al., Positional Bias of MHC Class I Restricted T-Cell Epitopes in Viral Antigens Is Likely due to a Bias in Conservation. PLoS Computational Biology 9(1):e1002884,8 Pages (2013).
Klebanoff, Christopher A, et al., Therapeutic Cancer Vaccines: are we there yet?. Immunological Reviews 239(1):27-44 (2011).
Klein, Allon M, et al., Droplet Barcoding for Single-cell Transcriptomics Applied to Embryonic Stem Cells. Cell 161(5):1187-1201 (2015).
Kloor, Matthias, et al., Immune Evasion of Microsatellite Unstable Colorectal Cancers. International Journal of Cancer 127(5):1001-1010 (2010).
Klug, Felix, et al., Characterization of MHC Ligands for Peptide Based Tumor Vaccination. Current Pharmaceutical Design 15(28):3221-3236 (2009).
Kress, W. John, et al., DNA Barcodes: Genes, Genomics, and Bioinformatics. Proceedings of the National Academy of Sciences of the United States of America 105(8):2761-2762 (2008).
Landau, Dan A, et al., Clonal Evolution in Hematological Malignancies and Therapeutic Implications. Leukemia 28(1):34-43 (2014).
Landau, Dan A, et al., Evolution and Impact of Subclonal Mutations in Chronic Lymphocytic Leukemia. Cell 152(4):714-726 (2013).
Langmead, Ben, et al., Fast Gapped-Read Alignment with Bowtie 2. Nature Methods 9(4):357-359 (2012).
Langmead, Ben, et al., Ultrafast and Memory-Efficient Alignment of Short DNA Sequences to the Human Genome. Genome Biology 10(3):R25,10 Pages (2009).
Lata, Sneh, et al., MHCBN 4.0: A Database of MHC/TAP Binding Peptides and T-cell Epitopes. BMC Research Notes 2:61,6 Pages (2009).
Lawrence, Michael S, et al., Discovery and Saturation Analysis of Cancer Genes Across 21 Tumour Types. Nature 505(7484):495-501 (2014).
Lawrence, Michael S, et al., Mutational Heterogeneity in Cancer and the Search for New Cancer-Associated Genes. Nature 499(7457):214-218 (2013).
Lee, Jae H, et al., Sequential Amplification of Cloned DNA as Tandem Multimers using Class-IIS Restriction Enzymes. Genetic Analysis: Biomolecular Engineering 13(6):139-145 (1996).
Leffers, Ninke, et al., Immunization with a P53 Synthetic Long Peptide Vaccine Induces P53-Specific Immune Responses in Ovarian Cancer Patients, a Phase II Trial. International Journal of Cancer 125(9):2104-2113 (2009).
Leffers, Ninke, et al., Long-term Clinical and Immunological Effects of p53-SLP® Vaccine in Patients with Ovarian Cancer. International Journal of Cancer 130(1):105-112 (2012).
Lemay, Serge, et al., Dok-3, A Novel Adapter Molecule Involved in the Negative Regulation of Immunoreceptor Signaling. Molecular and Cellular Biology 20:2743-2754 (2000).
Lewintre, Eloisa, et al., Analysis of Chronic Lymphotic Leukemia Transcriptomic Profile: Differences Between Molecular Subgroups. Leukemia & Lymphoma 50:68-79 (2009).
Li, Bo, et al., RSEM: Accurate Transcript Quantification from RNA-Seq Data With or Without a Reference Genome. BMC Bioinformatics 12:323,1-16 (2011).
Li, Heng, et al., Fast and Accurate Long-Read Alignment with Burrows-Wheeler Transform. Bioinformatics 26(5):589-595 (2010).
Li, Heng, et al., Fast and Accurate Short Read Alignment with Burrows-Wheeler Transform. Bioinformatics 25(14):1754-1760 (2009).
Li, Heng et al. Mapping Short DNA Sequencing Reads and Calling Variants Using Mapping Quality Scores. Genome Research 18(11):1851-1858 (2008).
Li, Heng et al. The sequence alignment/map format and SAMtools. Bioinformatics 25(16):2078-2079 (2009).
Lim, Elgene, et al., Transcriptome Analyses of Mouse and Human Mammary Cell Subpopulations Reveal Multiple Conserved Genes and Pathways. Breast Cancer Research 12:R21,1-14 (2010).
Lin, Katherine, et al., Relevance of the Immunoglobulin $V_H$ Somatic Mutation Status in Patients with Chronic Lymphocytic Leukemia Treated with Fludarabine, Cyclophosphamide, and Rituximab (FCR) or Related Chemoimmunotherapy Regimens. Blood 113:3168-3171 (2009).
Linardou, Helena, et al., Assessment of Somatic k-RAS Mutations as a Mechanism Associated with Resistance to EGFR-targeted Agents: A Systematic Review and Meta-Analysis of Studies in Advanced Non-Small-Cell Lung Cancer and Metastatic Colorectal Cancer. The Lancet Oncology 9(10):962-972 (2008).
Livak, Kenneth J, et al., Methods for qPCR Gene Expression Profiling Applied to 144o Lymphoblastoid Single Cells. Methods 59(1):71-79 (2013).
Lohr, Jens, et al., Discovery and Prioritization of Somatic Mutations in Diffuse Large B-cell Lymphoma (DLBCL) by Whole-Exome Sequencing. Proceedings of the National Academy of Sciences of the United States of America 109(10):3879-3884 (2012).
Lorente, Elena, et al., Diversity of Natural Self-Derived Ligands Presented by Different HLA Class I Molecules in Transporter Antigen Processing-deficient Cells. PLoS One 8:10 pages (2013).
Lu, Yong-Chen, et al., Mutated PPP1R3B is Recognized by T Cells Used to Treat a Melanoma Patient Who Experienced a Durable Complete Tumor Regression. Journal of Immunology 190(12):6034-6042 (2013).
Lucas, S, et al., About Human Tumor Antigens to be used in Immunotherapy. Seminars in Immunology 20(5):301-307 (2008).
Luo, Heng, et al., Machine Learning Methods for Predicting HLA-Peptide Binding Activity. Bioinformatics and Biology Insights 9(S3):21-29 (2015).
M F del Guercio et al., Binding of a peptide antigen to multiple HLA alleles allows definition of an A2-like supertype, The Journal of Immunology Jan. 15, 1995, 154 (2) 685-693.
McMurtrey, Curtis, et al., Toxoplasma Gondii Peptide Ligands Open the Gate of the HLA Class I Binding Groove. eLife 5:e12556,19 Pages (2016).
Medema, Jan Paul, et al., Immune Escape of Tumors in Vivo by Expression of Cellular FLICE-Inhibitory Protein. The Journal of Experimental Medicine 190:1033-1038 (1999).
Milner, Elena, et al., The Effect of Proteasome Inhibition on the Generation of the Human Leukocyte Antigen (HLA) Peptidome. Molecular & Cellular Proteomics 12:1853-1864 (2013).
Milner, Elena, et al., The Turnover Kinetics of Major Histocompatibility Complex Peptides of Human Cancer Cells. Molecular & Cellular Proteomics 5:357-365 (2006).

(56) References Cited

OTHER PUBLICATIONS

Missale, Gabriele, et al., HLA-A31- and HLA-Aw68-restricted Cytotoxic T Cell Responses to a Single Hepatitis B Virus Nucleocapsid Epitope During Acute Viral Hepatitis. The Journal of Experimental Medicine 177(3):751-762 (1993).
Morton, Donald L, et al., Prolonged Survival of Patients Receiving Active Immunotherapy With Canvaxin Therapeutic Polyvalent Vaccine After Complete Resection of Melanoma Metastatic to Regional Lymph Nodes. Annals of Surgery 236(4):438-448 (2002).
Mosmann, T.R, et al., TH1 and TH2 Cells: Different Patterns of Lymphokine Secretion Lead to Different Functional Properties. Annual Review of Immunology 7:145-173 (1989).
Muntel, Jan, et al., Abundance-based Classifier for the Prediction of Mass Spectrometric Peptide Detectability Upon Enrichment (PPA). Molecular & Cellular Proteomics 14:430-440 (2015).
Nielsen, Morten, et al., NetMHCpan, a Method for Quantitative Predictions of Peptide Binding to Any HLA-A and -B Locus Protein of Known Sequence. PLoS One 2:e796, 10 Pages (2007).
Nielsen, Morten, et al., NetMHCpan-3.0; Improved Prediction of Binding to MHC Class I Molecules Integrating Information from Multiple Receptor and Peptide Length Datasets. Genome Medicine 8:33,9 Pages (2016).
Nielsen, Morten, et al., The Role of the Proteasome in Generating Cytotoxic T-cell Epitopes: Insights Obtained from Improved Predictions of Proteasomal Cleavage. Immunogenetics 57:33-41 (2005).
Okada, Hideho, et al., Induction of CD8+ T-cell Responses Against Novel Glioma-associated Antigen Peptides and Clinical Activity by Vaccinations With {alpha}-type 1 Polarized Dendritic Cells and Polyinosinic-Polycytidylic Acid Stabilized by Lysine and Carboxymethylcellulose in Patients With Recurrent Malignant Glioma. Journal of Clinical Oncology 29(3):330-336 (2011).
Ott, Patrick, et al., CTLA-4 and PD-1/PD-L1 blockade: New Immunotherapeutic Modalities With Durable Clinical Benefit in Melanoma Patients. Clinical Cancer Research 19(19):5300-5309 (2013).
Pagès, Franck, et al., Effector Memory T Cells, Early Metastasis, and Survival in Colorectal Cancer. New England Journal of Medicine 353(25):2654-2666 (2005).
Pan et al.: Immunoprevention of KRAS-driven lung adenocarcinoma by a multipeptide vaccine. Oncotarget. 8(47):82689-82699 (2017).
Quesada, Víctor, et al., Exome Sequencing Identifies Recurrent Mutations of the Splicing Factor SF3B1 Gene in Chronic Lymphocytic Leukemia. Nature genetics 44(1):47-52 (2011).
Quezada, Sergio, et al., CTLA4 Blockade and GM-CSF Combination Immunotherapy Alters the Intratumor Balance of Effector and Regulatory T Cells. Journal of Clinical Investigation 116(7):1935-1945 (2006).
Ramsköld, Daniel, et al., Full-length mRNA-Seq From Single-cell Levels of RNA and Individual Circulating Tumor Cells. Nature Biotechnology 30(8):777-782 (2012).
Richter, Wolfgang F, et al., Mechanistic Determinants of Biotherapeutics Absorption Following SC Administration. American Association of Pharmaceutical Scientists Journal 14(3):559-570 (2012).
Rini, Brian I, et al., Biology and Treatment of Advanced Renal Cell Carcinoma: a Global Perspective. Seminars in oncology 40(4):419-420 (2013).
Robbins, Paul F, et al., Mining Exomic Sequencing Data to Identify Mutated Antigens Recognized by Adoptively Transferred Tumor-reactive T Cells. Nature Medicine 19(6):747-752 (2013).
Robinson, James T, et al., Integrative Genomics Viewer. Nature Biotechnology 29(1):24-26 (2011).
Robinson, R A, et al., A Phase I-II Trial of Multiple-dose Polyriboinosic-polyribocytidylic Acid in Patients With Leukemia or Solid Tumors. Journal of the National Cancer Institute 57(3):599-602 (1976).
Rosenberg, Steven A., Raising the Bar: the Curative Potential of Human Cancer Immunotherapy. Science Translational Medicine 4(127):127ps8, 5 pages (2012).
Rossi, Davide, et al., Integrated Mutational and Cytogenetic Analysis Identifies New Prognostic Subgroups in Chronic Lymphocytic Leukemia. Blood 121(8):1403-1412 (2013).
Rubin, Alan F, et al., Mutation Patterns in Cancer Genomes. Proceedings of the National Academy of Sciences of the United States of America 106(51):21766-21770 (2009).
Rubio-Moscardo, Fanny, et al., Characterization of 8p21.3 Chromosomal Deletions in B-cell Lymphoma: TRAIL-R1 and TRAIL-R2 as Candidate Dosage-dependent Tumor Suppressor Genes. Blood 106(9):3214-3222 (2005).
Rutledge, Caleb W, et al., Tumor-infiltrating Lymphocytes in Glioblastoma Are Associated With Specific Genomic Alterations and Related to Transcriptional Class. Clinical Cancer Research 19(18):4951-4960 (2013).
Salem, Mohamed L, et al., Defining the Antigen-specific T-cell Response to Vaccination and Poly(I:C)/TLR3 Signaling: Evidence of Enhanced Primary and Memory CD8 T-cell Responses and Antitumor Immunity. Journal of Immunotherapy 28(3):220-228 (2005).
Schmitt, Katja, et al., Transcriptional Profiling of Human Endogenous Retrovirus Group HERV-K(HML-2) Loci in Melanoma. Genome Biology and Evolution 5(2):307-328 (2013).
Schreiber, Robert D, et al., Cancer Immunoediting: Integrating Immunity's Roles in Cancer Suppression and Promotion. Science 331(6024):1565-1570 (2011).
Schumacher, K, et al., Prognostic Significance of Activated CD8(+) T Cell Infiltrations Within Esophageal Carcinomas. Cancer research 61(10):3932-3936 (2001).
Schuster, Stephen J, et al., Vaccination With Patient-specific Tumor-derived Antigen in First Remission Improves Disease-free Survival in Follicular Lymphoma. Journal of Clinical Oncology 29(20):2787-2794 (2011).
Sensi, Marialuisa, et al., Unique Tumor Antigens: Evidence for Immune Control of Genome Integrity and Immunogenic Targets for T Cell-mediated Patient-specific Immunotherapy. Clinical Cancer Research 12(17):5023-5032 (2006).
Sette et al.,. Peptide binding to the most frequent HLA-A class I alleles measured by quantitative molecular binding assays. Mol Immunol. Aug. 1994;31(11):813-22. doi: 10.1016/0161-5890(94)90019-1. PMID: 8047072.
Shendure, Jay et al. Next-generation DNA Sequencing. Nature Biotechnology vol. 26,10: pp. 1135-1145 (2008).
Sidney et al., Measurement of MHC/peptide interactions by gel filtration or monoclonal antibody capture. Curr Protoc Immunol. Feb. 2013;Chapter 18:Unit 18.3.. doi: 10.1002/0471142735.im1803s100. PMID: 23392640; PMCID: PMC3626435.
Sidney, John, et al., HLA Class I Supertypes: a Revised and Updated Classification. BioMed Central Immunology 9:1, 15 Pages (2008).
Sidney, John. et al. Several HLA Alleles Share Overlapping Peptide Specificities. The Journal of Immunology 154(1):247-259 (1995).
Simmons, Andrew D, et al., Local Secretion of Anti-CTLA-4 Enhances the Therapeutic Efficacy of a Cancer Immunotherapy With Reduced Evidence of Systemic Autoimmunity. Cancer Immunology and Immunotherapy 57(8):1263-1270 (2008).
Simpson, Tyler R, et al., Fc-dependent Depletion of Tumor-infiltrating Regulatory T Cells Co-defines the Efficacy of Anti-CTLA-4 Therapy Against Melanoma. Journal of Experimental Medicine 210(9):1695-1710 (2013).
Slingluff, Craig L, et al., Randomized Multicenter Trial of the Effects of Melanoma-associated Helper Peptides and Cyclophosphamide on the Immunogenicity of a Multipeptide Melanoma Vaccine. Journal of Clinical Oncology 29(21):2924-2932 (2011).
Soares, Helena, et al., A Subset of Dendritic Cells Induces Cd4+ T Cells to Produce IFN-gamma by an Il-12-independent but CD70-dependent Mechanism in Vivo. The Journal of Experimental Medicine 2215(11):1095-1106 (2007).
Song, Shengli, et al., Full Screening and Accurate Subtyping of HLA-A*02 Alleles Through Group-specific Amplification and Mono-allelic Sequencing. Cellular and Molecular Immunology 10(6):490-496 (2013).
Sosman, Jeffrey A, et al., A Phase 2 Trial of Complete Resection for Stage IV Melanoma: results of Southwest Oncology Group Clinical Trial S9430. Cancer 117(20):4740-4746 (2011).
Speetjens, Frank M, et al., Induction of P53-specific Immunity by a P53 Synthetic Long Peptide Vaccine in Patients Treated for

(56) References Cited

OTHER PUBLICATIONS

Metastatic Colorectal Cancer. Clinical Cancer Research: an Official Journal of the American Association for Cancer Research 15(3):1086-1095 (2009).
Spranger, Stefani, et al., Up-regulation of PD-L1, IDO, and T(regs) in the Melanoma Tumor Microenvironment is Driven by CD8+ T Cells. Science Translational Medicine 5(200):200ra116,10pages (2013).
Srivastava, Nisheeth, et al., Modeling the Repertoire of True Tumor-specific MHC I Epitopes in a Human Tumor. PloS One 4(7):e6094, 5pages (2009).
Srivastava, Pramod K., Therapeutic Cancer Vaccines, Current Opinion in Immunology 18:201-205 (2006).
Stransky, Nicolas, et al., The Mutational Landscape of Head and Neck Squamous Cell Carcinoma. Science 333:1157-1160 (2011).
Stranzl, Thomas, et al., NetCTLpan: Pan-Specific MHC Class I Pathway Epitope Predictions. Immunogenetics 62(6):357-368 (2010).
Su, Zhenqiang, et al., Next-generation Sequencing and its Applications in Molecular Diagnostics. Expert Review of Molecular Diagnostics 11(3):333-343 (2011).
Sykulev, Yuri, et al., Evidence That a Single Peptide-MHC Complex on a Target Cell Can Elicit a Cytolytic T Cell Response. Immunity 4:565-571 (1996).
Tang, Shaojun, et al., NeoantigenR: An Annotation Based Pipeline for Tumor Neoantigen Identification from Sequencing Data. BioRxiv preprint :19pages (2017).
Ten Bosch, John R, et al., Keeping Up With the Next Generation: Massively Parallel Sequencing in Clinical Diagnostics. The Journal of Molecular Diagnostics 10(6):484-492 (2008).
Testori, Alessandro, et al., Phase III Comparison of Vitespen, an Autologous Tumor-derived Heat Shock Protein gp96 Peptide Complex Vaccine, With Physician's Choice of Treatment for Stage IV Melanoma: the C-100-21 Study Group. Journal of clinical oncology : official journal of the American Society of Clinical Oncology 26(6):955-962 (2008).
The Cancer Genome Atlas Network, Comprehensive Molecular Portraits of Human Breast Tumours. Nature 490(7418):61-70 (2012).
The GTEx Consortium., The Genotype-Tissue Expression (GTEx) Project. Nature Genetics 45(6):580-585 (2013).
Tran, Eric et al., Cancer Immunotherapy Based on Mutation-Specific CD4+ T Cells in a Patient with Epithelial Cancer. Science 344(6184):641-645 (2014).
Trolle, Thomas, et al., Automated Benchmarking of Peptide-MHC Class I Binding Predictions. Bioinformatics 31(13):2174-2181 (2015).
Trumpfheller, Christine, et al., The Microbial Mimic Poly IC Induces Durable and Protective CD4+ T Cell Immunity Together With a Dendritic Cell Targeted Vaccine. Proceedings of the National Academy of Sciences of the United States of America 105(7):2574-2579 (2008).
Tucker, Tracy, et al., Massively Parallel Sequencing: The Next Big Thing in Genetic Medicine. American Journal of Human Genetics 85(2):142-154 (2009).
Van Buuren, Marit M, et al., High Sensitivity of Cancer Exome-based CD8 T Cell Neo-antigen Identification. OncoImmunology 3(5):e28836,6pages (2014).
Van Elsas, Andrea, et al., Combination Immunotherapy of B16 Melanoma Using Anti-cytotoxic T Lymphocyte-associated Antigen 4 (CTLA-4) and Granulocyte/Macrophage Colony-stimulating Factor (GM-CSF)-producing Vaccines Induces Rejection of Subcutaneous and Metastatic Tumors Accompanied by Autoimmune Depigmentation. Journal of Experimental Medicine 190(3):355-366,12pages (1999).
Vermeji, Renee et al., Potentiation of a P53-SLP Vaccine by Cyclophosphamide in Ovarian Cancer: A Single-Arm Phase II Study. International Journal of Cancer 131(5):e670-680 (2012).
Vogel, Roland, et al., Mass Spectrometry Reveals Changes in MHC I Antigen Presentation After Lentivector Expression of a Gene Regulation System. Molecular Therapy-Nucleic Acids 2:e75,8pages (2013).
Wang et al.: Identification of T-cell Receptors Targeting KRAS-Mutated Human Tumors. Cancer Immunol Res. 4(3):204-214 (2016).
Wang, Guixia, et al., Role of Protein Kinase CK2 in the Regulation of Tumor Necrosis Factor-related Apoptosis Inducing Ligand-induced Apoptosis in Prostate Cancer Cells. Cancer Research 66:2242-2249 (2006).
Wang, Lili, et al., SF3B1 and Other Novel Cancer Genes in Chronic Lymphocytic Leukemia. The New England Journal of Medicine 365:2497-2506 (2011).
Wierda, William G, et al., Multivariable Model for Time to First Treatment in Patients With Chronic Lymphocytic Leukemia. Journal of Clinical Oncology 29(31):4088-4095 (2011).
Wolchok, Jedd D, et al., Nivolumab Plus Ipilimumab in Advanced Melanoma. The New England Journal of Medicine 369(2):122-133 (2013).
Woyach, Jennifer A, et al., Resistance Mechanisms for the Bruton's Tyrosine Kinase Inhibitor Ibrutinib. The New England Journal of Medicine 370:2286-2294 (2014).
Wraith, David C., The Future of Immunotherapy: A 20-Year Perspective, Frontiers in Immunology 8:1668, 6pages (2017).
Yang, Wanling, et al., Meta-analysis followed by Replication Identifies loci in or near CDKN1B, TET3, CD80, DRAM1, and ARID5B as Associated with systemic Lupus Erythematosus in Asians, American Journal of Human Genetics, 92:41-51 (2013).
Zhou et al.: TSNAD: an integrated software for cancer somatic mutation and tumour-specific neoantigen detection. Royal Society Open Science. 4(4):170050 (2017).
Zhu, Xinmei, et al., Toll Like Receptor-3 Ligand Poly-ICLC Promotes the Efficacy of Peripheral Vaccinations With Tumor Antigen-derived Peptide Epitopes in Murine CNS Tumor Models. Journal of Translational Medicine 5:10, 15 Pages (2007).

\* cited by examiner

| Allele | Mutation | Epitope | Detected by MS? |
|---|---|---|---|
| A*02:01 | G12C | LVVVGACGV | - |
| | G12C | KLVVVGACGV | - |
| | G12D | LVVVGADGV | - |
| | G12D | KLVVVGADGV | - |
| | G12V | LVVVGAVGV | - |
| | G12V | KLVVVGAVGV | - |
| A*03:01 | G12C | VGACGVGK | - |
| | G12C | VVGACGVGK | ✓ |
| | G12D | VGADGVGK | - |
| | G12D | VVGADGVGK | - |
| | G12V | VGAVGVGK | ✓ |
| | G12V | VVGAVGVGK | ✓ |
| A*11:01 | G12C | VGACGVGK | - |
| | G12C | VVGACGVGK | ✓ |
| | G12D | VGADGVGK | - |
| | G12D | VVGADGVGK | ✓ |
| | G12V | VGAVGVGK | ✓ |
| | G12V | VVGAVGVGK | ✓ |
| B*08:01 | G12D | DGVGKSAL | - |
| | G12D | DGVGKSALT | - |
| | G12D | DGVGKSALTI | - |

✓ Detected
- Assayed for, but not detected

FIG. 2B

Stimulating peptide: TEYKLVVVGAVGVGKSALTI
Minimal epitope used for multimer detection: (V)VVGAVGVGK

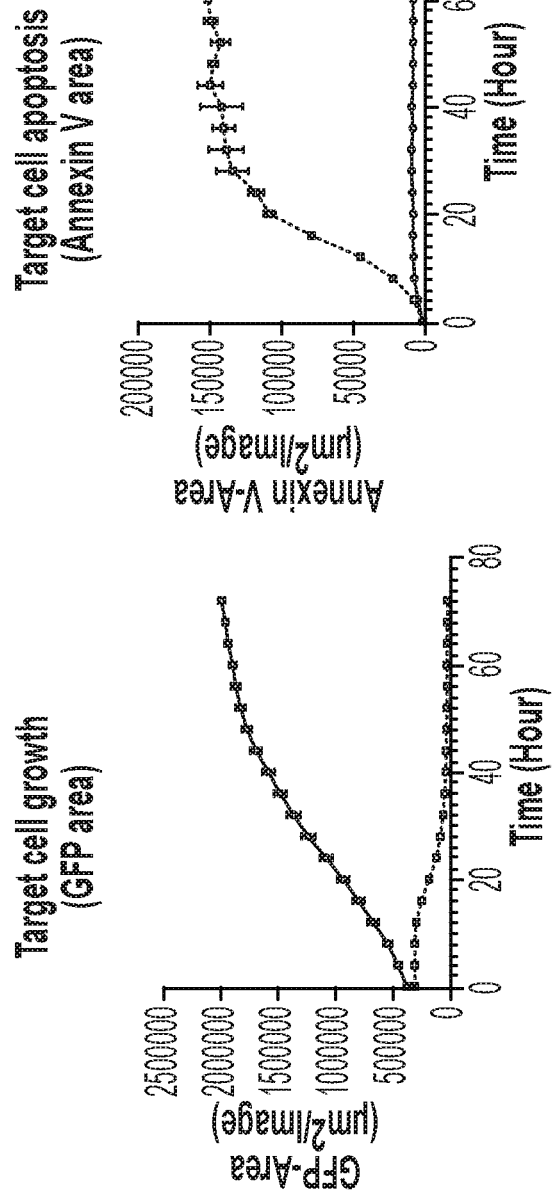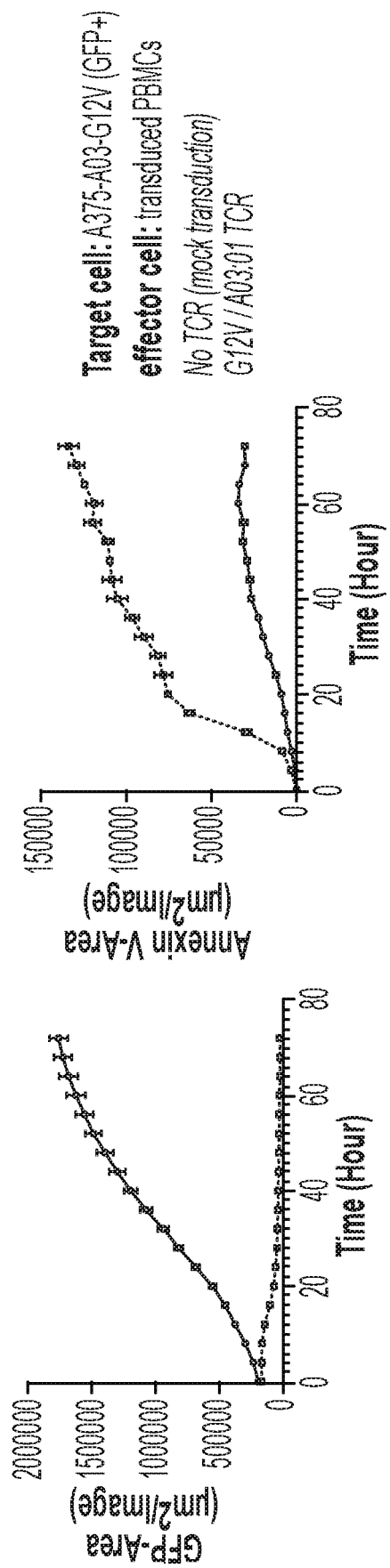

NEOANTIGENS AND USES THEREOF

CROSS-REFERENCE

This application claims priority to U.S. Provisional Application No. 62/687,188, filed on Jun. 19, 2018 and 62/800,735, filed on Feb. 4, 2019; which are incorporated herein by reference in their entirety.

SEQUENCE LISTING INFORMATION

This Application contains sequence listing information provided in ASCII format named 50401-730.601_SL.txt, which is 742,423 bytes in size and is hereby fully incorporated by reference.

BACKGROUND

Cancer immunotherapy is the use of the immune system to treat cancer. Immunotherapies exploit the fact that cancer cells often have molecules on their surface that can be detected by the immune system, known as tumor antigens, which are often proteins or other macromolecules (e.g. carbohydrates). Active immunotherapy directs the immune system to attack tumor cells by targeting tumor antigens. Passive immunotherapies enhance existing anti-tumor responses and include the use of monoclonal antibodies, lymphocytes and cytokines. Tumor vaccines are typically composed of tumor antigens and immunostimulatory molecules (e.g., adjuvants, cytokines or TLR ligands) that work together to induce antigen-specific cytotoxic T cells (CTLs) that recognize and lyse tumor cells. One of the critical barriers to developing curative and tumor-specific immunotherapy is the identification and selection of highly specific and restricted tumor antigens to avoid autoimmunity.

Tumor neoantigens, which arise as a result of genetic change (e.g., inversions, translocations, deletions, missense mutations, splice site mutations, etc.) within malignant cells, represent the most tumor-specific class of antigens and can be patient-specific or shared. Tumor neoantigens are unique to the tumor cell as the mutation and its corresponding protein are present only in the tumor. They also avoid central tolerance and are therefore more likely to be immunogenic. Therefore, tumor neoantigens provide an excellent target for immune recognition including by both humoral and cellular immunity. However, tumor neoantigens have rarely been used in cancer vaccine or immunogenic compositions due to technical difficulties in identifying them, selecting optimized antigens, and producing neoantigens for use in a vaccine or immunogenic composition. Accordingly, there is still a need for developing additional cancer therapeutics.

INCORPORATION BY REFERENCE

All publications, patents, and patent applications mentioned in this specification are herein incorporated by reference to the same extent as if each individual publication, patent, or patent application was specifically and individually indicated to be incorporated by reference.

SUMMARY

In some aspects, provided herein is a composition comprising at least one peptide comprising two or more mutant RAS peptide sequences selected from the group consisting of

KLVVVGADGV, (SEQ ID NO: 1)

KLVVVGACGV, (SEQ ID NO: 2)

KLVVVGAVGV, (SEQ ID NO: 3)

LVVVGADGV, (SEQ ID NO: 4)

LVVVGACGV, (SEQ ID NO: 5)

LVVVGAVGV; (SEQ ID NO: 6)

GADGVGKSAL, (SEQ ID NO: 7)

GACGVGKSAL, (SEQ ID NO: 8)

GAVGVGKSAL, (SEQ ID NO: 9)

GADGVGKSA, (SEQ ID NO: 10)

GACGVGKSA, (SEQ ID NO: 11)

GAVGVGKSA; and/or (SEQ ID NO: 12)

VVGADGVGK, (SEQ ID NO: 13)

VVGACGVGK, (SEQ ID NO: 14)

VVGAVGVGK, (SEQ ID NO: 15)

VVVGADGVGK, (SEQ ID NO: 16)

VVVGACGVGK, (SEQ ID NO: 17)

VVVGAVGVGK; (SEQ ID NO: 18)

at least one polynucleotide encoding the at least one polypeptide.

In some embodiments, the composition comprises a mixture of the three or more mutant RAS peptide sequences.

In some aspects, provided herein is a composition comprising: at least one polypeptide comprising two or more mutant RAS peptide sequences each comprising: at least 8 contiguous amino acids of a mutant RAS protein comprising a mutation at G12, and the mutation at G12; and further wherein three or more amino acid residues that are heterologous to the mutant RAS protein are linked to the N-terminus or C-terminus of the two or more mutant RAS peptide sequences, wherein the three or more amino acid residues enhance processing of the mutant RAS peptide sequences in cell and/or enhance presentation of an epitope of the mutant RAS peptide sequences; or at least one polynucleotide encoding the at least one polypeptide.

In some embodiments, the three or more amino acid residues that are heterologous to the mutant RAS protein are linked to the N-terminus or C-terminus of the two or more mutant RAS peptide sequences comprises an amino acid sequence of a protein of CMV such as pp65, HIV, or MART-1.

In some embodiments, the three or more amino acid residues that are heterologous to the mutant RAS protein are linked to the N-terminus or C-terminus of the two or more mutant RAS peptide sequences comprises at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 amino acids.

In some embodiments, the three or more amino acid residues that are heterologous to the mutant RAS protein are linked to the N-terminus or C-terminus of the two or more mutant RAS peptide sequences comprises at most 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 50, 60, 70, 80, 90, or 100 amino acids.

In some aspects, provided herein is a composition comprising at least one polypeptide of the formula $(Xaa_N)_N$-$(Xaa_{RAS})_P$-$(Xaa_C)_C$ wherein P is an integer greater than 7; $(XaaRAS)_P$ is a mutant RAS peptide sequence comprising at least 8 contiguous amino acids of a mutant RAS protein; the at least 8 contiguous amino acids comprising at least 8 contiguous amino acids of the sequence Lys1 Leu2 Val3 Val4 Val5 Gly6 Ala7 Xaa8 Gly9 Val10 Gly11 Lys12 Ser13 Ala14 Leu15 (SEQ ID NO: 19) N is (i) 0 or (ii) an integer greater than 2; $(Xaa_N)_N$ is any amino acid sequence heterologous to the mutant RAS protein; C is (i) 0 or (ii) an integer greater than 2; $(Xaa_C)_C$ is any amino acid sequence heterologous to the mutant RAS protein; Xaa8 is selected from the group consisting of Asp, Val, Cys, Ala, Arg and Ser; the polypeptide is not

KLVVVGAVGVGKSALTIQL; (SEQ ID NO: 20)

and both N and C are not 0; or at least one polynucleotide encoding the at least one polypeptide.

In some embodiments, $(Xaa)_N$ and/or $(XaaC)_C$ comprises an amino acid sequence of a protein of CMV such as pp65, HIV, or MART-1.

In some embodiments, N and/or C is an integer greater than 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40.

In some embodiments, N and/or C is an integer less than 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 50, 60, 70, 80, 90, or 100.

In some embodiments, N is 0.

In some embodiments, C is 0.

In some aspects, provided herein is a composition comprising at least one polypeptide comprising of an amino acid sequence of $Xaa_1$-$Xaa_2$-$Val_3$-$Val_4$-$Val_5$-$Gly_6$-$Ala_7$-$Xaa_8$-$Gly_9$-$Xaa_{10}$ (SEQ ID NO: 21) wherein $Xaa_1$ is not Ala; with the proviso that when $Xaa_1$ is not Lys, $Xaa_2$ is Leu and/or $Xaa_{10}$ is Gly; $Xaa_2$ is not Glu; with the proviso that when $Xaa_2$ is not Leu, $Xaa_1$ is Lys and/or $Xaa_{10}$ is Gly; $Xaa_8$ is selected from the group consisting of Asp, Val, Cys, Ala, Arg and Ser; with the proviso that when $Xaa_8$ is Glu, Xaa1 is not Tyr and/or $Xaa_2$ is not Leu, and with the proviso that when $Xaa_8$ is Val, $Xaa_1$ is not Lys; $Xaa_{10}$ is any amino acid; with the proviso that when $Xaa_{10}$ is not Gly, $Xaa_1$ is Lys and/or $Xaa_2$ is Leu; and the polypeptide comprises an HLA-A02:01-restricted T cell epitope, HLA-A03:01-restricted T cell epitope, an HLA-A11:01-restricted T cell epitope, an HLA-A03:02-restricted T cell epitope, an HLA-A30:01-restricted T cell epitope, an HLA-A31:01-restricted T cell epitope, an HLA-A33:01-restricted T cell epitope, an HLA-A33:03-restricted T cell epitope, an HLA-A68:01-restricted T cell epitope, or an HLA-A74:01-restricted T cell epitope that binds to an HLA-A02:01, HLA-A03:01, HLA-A11:01, HLA-A03:02, HLA-A30:01, HLA-A31:01, HLA-A33:01, HLA-A33:03, HLA-A68:01, and/or an HLA-A74:01 molecule; and induces an HLA-A02:01-restricted cytotoxic T cell response, an HLA-A02:01-restricted cytotoxic T cell response, HLA-A03:01-restricted cytotoxic T cell response, an HLA-A11:01-restricted cytotoxic T cell response, an HLA-A03:02-restricted cytotoxic T cell response, an HLA-A30:01-restricted cytotoxic T cell response, an HLA-A31:01-restricted cytotoxic T cell response, an HLA-A33:01-restricted cytotoxic T cell response, an HLA-A33:03-restricted cytotoxic T cell response, an HLA-A68:01-restricted cytotoxic T cell response, or an HLA-A74:01-restricted cytotoxic T cell response; and that binds to an HLA-A02:01, HLA-A03:01, HLA-A11:01, HLA-A03:02, HLA-A30:01, HLA-A31:01, HLA-A33:01, HLA-A33:03, HLA-A68:01, and/or an HLA-A74:01; or at least one polynucleotide encoding the at least one polypeptide.

In some aspects, provided herein is a composition comprising at least one polypeptide comprising one or more mutant RAS peptide sequences each comprising: at least 8 contiguous amino acids of a mutant RAS protein comprising a G12A, G12C, G12D, G12R, G12S, or G12V mutation, and the G12A, G12C, G12D, G12R, G12S, or G12V mutation; and further wherein the peptide: comprises a mutation not encoded by a genome of a cancer cell and has an affinity or predicted affinity of 150 nM or less for an HLA-A02:01 allele and/or a half-life of 2 hours or more, or has a half-life of 2 hours or more and an affinity or predicted affinity of 150 nM or less for an HLA-A02:01 allele, an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, or an HLA-A74:01 allele and/or an HLA-C08:02 allele; or at least one polynucleotide encoding the at least one polypeptide.

In some embodiments, the composition further comprises (i) a peptide comprising a peptide sequence in any one of Table 3 to 14, or (ii) a polynucleotide encoding the peptide comprising a sequence in Table 3 to 14.

In some aspects, provided herein is a composition comprising: (a) at least one polypeptide comprising one or more mutant RAS peptide sequences selected from the group consisting of:

DTAGHEEY, (SEQ ID NO: 22)

TAGHEEYSAM, (SEQ ID NO: 23)

DILDTAGHE, (SEQ ID NO: 24)

DILDTAGH, (SEQ ID NO: 25)

ILDTAGHEE, (SEQ ID NO: 26)

ILDTAGHE, (SEQ ID NO: 27)

DILDTAGHEEY, (SEQ ID NO: 28)

-continued

DTAGHEEYS, (SEQ ID NO: 29)

LLDILDTAGH, (SEQ ID NO: 30)

DILDTAGRE, (SEQ ID NO: 31)

DILDTAGR, (SEQ ID NO: 32)

ILDTAGREE, (SEQ ID NO: 33)

ILDTAGRE, (SEQ ID NO: 34)

CLLDILDTAGR, (SEQ ID NO: 35)

TAGREEYSAM, (SEQ ID NO: 36)

REEYSAMRD, (SEQ ID NO: 37)

DTAGKEEYSAM, (SEQ ID NO: 38)

CLLDILDTAGK, (SEQ ID NO: 39)

DTAGKEEY, (SEQ ID NO: 40)

LLDILDTAGK, (SEQ ID NO: 41)

ILDTAGKE, (SEQ ID NO: 42)

ILDTAGKEE, (SEQ ID NO: 43)

DTAGLEEY, (SEQ ID NO: 44)

ILDTAGLE, (SEQ ID NO: 45)

DILDTAGL, (SEQ ID NO: 46)

ILDTAGLEE, (SEQ ID NO: 47)

GLEEYSAMRDQY, (SEQ ID NO: 48)

LLDILDTAGLE, (SEQ ID NO: 49)

LDILDTAGL, (SEQ ID NO: 50)

DILDTAGLE, (SEQ ID NO: 51)

DILDTAGLEEY, (SEQ ID NO: 52)

AGVGKSAL, (SEQ ID NO: 53)

GAAGVGKSAL, (SEQ ID NO: 54)

AAGVGKSAL, (SEQ ID NO: 55)

CGVGKSAL, (SEQ ID NO: 56)

ACGVGKSAL, (SEQ ID NO: 57)

DGVGKSAL, (SEQ ID NO: 58)

ADGVGKSAL, (SEQ ID NO: 59)

DGVGKSALTI, (SEQ ID NO: 60)

GARGVGKSA, (SEQ ID NO: 61)

KLVVVGARGV, (SEQ ID NO: 62)

VVVGARGV, (SEQ ID NO: 63)

SGVGKSAL, (SEQ ID NO: 64)

VVVGASGVGK, (SEQ ID NO: 65)

GASGVGKSAL, (SEQ ID NO: 66)

VGVGKSAL, (SEQ ID NO: 67)

VVVGAGCVGK, (SEQ ID NO: 68)

KLVVVGAGC, (SEQ ID NO: 69)

GDVGKSAL, (SEQ ID NO: 70)

DVGKSALTI, (SEQ ID NO: 71)

VVVGAGDVGK, (SEQ ID NO: 72)

TAGKEEYSAM, (SEQ ID NO: 73)

DTAGHEEYSAM, (SEQ ID NO: 74)

TAGHEEYSA, (SEQ ID NO: 75)

DTAGREEYSAM, (SEQ ID NO: 76)

TAGKEEYSA, (SEQ ID NO: 77)

AAGVGKSA, (SEQ ID NO: 78)

AGCVGKSAL, (SEQ ID NO: 79)

AGDVGKSAL, (SEQ ID NO: 80)

AGKEEYSAMR, (SEQ ID NO: 81)

AGVGKSALTI, (SEQ ID NO: 82)

-continued

ARGVGKSAL, (SEQ ID NO: 83)

ASGVGKSA, (SEQ ID NO: 84)

ASGVGKSAL, (SEQ ID NO: 85)

AVGVGKSA, (SEQ ID NO: 86)

CVGKSALTI, (SEQ ID NO: 87)

DILDTAGK, (SEQ ID NO: 88)

DILDTAGREEY, (SEQ ID NO: 89)

DTAGHEEYSAMR, (SEQ ID NO: 90)

DTAGKEEYS, (SEQ ID NO: 91)

DTAGKEEYSAMR, (SEQ ID NO: 92)

DTAGLEEYS, (SEQ ID NO: 93)

DTAGLEEYSA, (SEQ ID NO: 94)

DTAGLEEYSAMR, (SEQ ID NO: 95)

DTAGREEYS, (SEQ ID NO: 96)

DTAGREEYSAMR, (SEQ ID NO: 97)

GAAGVGKSA, (SEQ ID NO: 98)

GACGVGKSA, (SEQ ID NO: 99)

GACGVGKSAL, (SEQ ID NO: 100)

GADGVGKS, (SEQ ID NO: 101)

GAGDVGKSA, (SEQ ID NO: 102)

GAGDVGKSAL, (SEQ ID NO: 103)

GASGVGKSA, (SEQ ID NO: 104)

GCVGKSAL, (SEQ ID NO: 105)

GCVGKSALTI, (SEQ ID NO: 106)

GHEEYSAM, (SEQ ID NO: 107)

GKEEYSAM, (SEQ ID NO: 108)

GLEEYSAMR, (SEQ ID NO: 109)

-continued

GREEYSAM, and (SEQ ID NO: 110)

GREEYSAMR, (SEQ ID NO: 111)

HEEYSAMRD, (SEQ ID NO: 112)

KEEYSAMRD, (SEQ ID NO: 113)

KLVVVGASG, (SEQ ID NO: 114)

LDILDTAGR, (SEQ ID NO: 115)

LEEYSAMRD, (SEQ ID NO: 116)

LVVVGARGV, (SEQ ID NO: 117)

LVVVGASGV, (SEQ ID NO: 118)

REEYSAMRDQY, (SEQ ID NO: 119)

RGVGKSAL, (SEQ ID NO: 120)

TAGLEEYSA, (SEQ ID NO: 121)

TEYKLVVVGAA, (SEQ ID NO: 122)

VGAAGVGKSA, (SEQ ID NO: 123)

VGADGVGK, (SEQ ID NO: 124)

VGASGVGKSA, (SEQ ID NO: 125)

VGVGKSALTI, (SEQ ID NO: 126)

VVVGAAGV, (SEQ ID NO: 127)

VVVGAVGV, (SEQ ID NO: 128)

YKLVVVGAC, (SEQ ID NO: 129)

YKLVVVGAD, (SEQ ID NO: 130)

YKLVVVGAR, (SEQ ID NO: 131)

DILDTAGKE; (SEQ ID NO: 132)

or (b) at least one polynucleotide encoding the at least one polypeptide.

In some embodiments, the composition further comprises (i) a peptide comprising a peptide sequence in any one of Table 1 to 14, or (ii) a polynucleotide encoding the peptide comprising a sequence in Table 1 to 14.

In some embodiments, at least one of the mutant RAS peptide sequences comprises N or C terminal amino acid sequence extension of at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 amino acids, wherein the N or C terminal extension is a wild-type RAS amino acid sequence or a non-heterologous RAS amino acid sequence.

In some embodiments, the at least one polypeptide comprises at least 3, 4, 5, 6, 7, 8, 9, or 10 mutant RAS peptide sequences.

In some embodiments, the at least one polypeptide comprises at least two polypeptides, or the at least one polynucleotide comprises at least two polynucleotides.

In some embodiments, at least one of the mutant RAS peptide sequences comprises at least 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 contiguous amino acids of a mutant RAS protein.

In some embodiments, at least 2, 3, 4, 5, 6, 7, 8, 9, or 10 of the mutant RAS peptide sequences comprise at least 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 contiguous amino acids of a mutant RAS protein.

In some embodiments, each of the mutant RAS peptide sequences or each of the two or more RAS peptide sequences comprises at least 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 contiguous amino acids of a mutant RAS protein.

In some embodiments, the at least one polypeptide comprises at least one mutant RAS peptide sequence that binds to or is predicted to bind to a protein encoded by an HLA-A02:01 allele, an HLA-A03:01 allele, an HLA-A11:01 allele, and/or an HLA-C08:02 allele.

In some embodiments, the at least one polypeptide comprises at least one mutant RAS peptide sequence that binds to or is predicted to bind to a protein encoded by: an HLA-A02:01 allele and an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, or an HLA-A74:01 allele; an HLA-A02:01 allele and an HLA-C08:02 allele; an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, or an HLA-A74:01 allele and an HLA-C08:02 allele; or an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, or an HLA-A74:01 allele and allele and an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, or an HLA-A74:01 allele.

In some embodiments, the mutant RAS peptide sequences comprise a first mutant RAS peptide sequence that binds to or is predicted to bind to a protein encoded by an HLA-A02:01 allele, an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, an HLA-A74:01 allele, and/or an HLA-C08:02 allele; and a second RAS peptide sequence that binds to or is predicted to bind to a protein encoded by an HLA-A02:01 allele, an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, an HLA-A74:01 allele, and/or an HLA-C08:02 allele; wherein the first mutant RAS peptide sequence binds to or is predicted to bind to a protein encoded by different HLA allele than the second mutant RAS peptide sequence.

In some embodiments, the at least one polypeptide comprises at least one mutant RAS peptide sequence that binds to a protein encoded by an HLA allele with an affinity of less than 10 µM, less than 1 µM, less than 500 nM, less than 400 nM, less than 300 nM, less than 250 nM, less than 200 nM, less than 150 nM, less than 100 nM, or less than 50 nM.

In some embodiments, the at least one polypeptide comprises at least one mutant RAS peptide sequence that binds to a protein encoded by an HLA allele with a stability of greater than 24 hours, greater than 12 hours, greater than 9 hours, greater than 6 hours, greater than 5 hours, greater than 4 hours, greater than 3 hours, greater than 2 hours, greater than 1 hour, greater than 45 minutes, greater than 30 minutes, greater than 15 minutes, or greater than 10 minutes.

In some embodiments, the HLA allele is selected from the group consisting of HLA-A02:01 allele, an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, an HLA-A74:01 allele, and/or an HLA-C08:02 allele and any combination thereof.

In some embodiments, the at least one polypeptide comprises at least one of the following sequences:

LVVVGACGV, (SEQ ID NO: 133)

KLVVVGACGV, (SEQ ID NO: 134)

LVVVGADGV, (SEQ ID NO: 135)

KLVVVGADGV, (SEQ ID NO: 136)

LVVVGAVGV, (SEQ ID NO: 137)

KLVVVGAVGV, (SEQ ID NO: 138)

VVGACGVGK, (SEQ ID NO: 139)

VVVGACGVGK, (SEQ ID NO: 140)

VVGADGVGK, (SEQ ID NO: 141)

VVVGADGVGK, (SEQ ID NO: 142)

VVGAVGVGK, (SEQ ID NO: 143)

VVVGAVGVGK, (SEQ ID NO: 144)

VVGACGVGK, (SEQ ID NO: 145)

VVGADGVGK, (SEQ ID NO: 146)

VVVGADGVGK, (SEQ ID NO: 147)

VVGAVGVGK, and (SEQ ID NO: 148)

VVVGAVGVGK. (SEQ ID NO: 149)

In some embodiments, the mutant RAS peptide sequences comprise at least one or two of the following sequences:

KLVVVGACGV, (SEQ ID NO: 150)

FLVVVGACGL, (SEQ ID NO: 151)

FMVVVGACGI, (SEQ ID NO: 152)

FLVVVGACGI, (SEQ ID NO: 153)

FMVVVGACGV, (SEQ ID NO: 154)

FLVVVGACGV, (SEQ ID NO: 155)

MLVVVGACGV, (SEQ ID NO: 156)

FMVVVGACGL, (SEQ ID NO: 157)

YLVVVGACGV, (SEQ ID NO: 158)

KMVVVGACGV, (SEQ ID NO: 159)

YMVVVGACGV, and (SEQ ID NO: 160)

MMVVVGACGV. (SEQ ID NO: 161)

In some embodiments, the mutant RAS peptide sequences comprise at least one or two of the following sequences:

TEYKLVVVGAVGV; (SEQ ID NO: 162)

WQAGILARKLVVVGAVGVQGQNLKYQ; (SEQ ID NO: 163)

HSYTTAEKLVVVGAVGVILGVLLLI; (SEQ ID NO: 164)

PLTEEKIKKLVVVGAVGVEKEGKISK; (SEQ ID NO: 165)

GALHFKPGSRKLVVVGAVGVAASDFIFLVT; (SEQ ID NO: 166)

RRANKDATAEKLVVVGAVGVKELKQVASPF; (SEQ ID NO: 167)

KAFISHEEKRKLVVVGAVGVKKKLINEKKE; (SEQ ID NO: 168)

TDLSSRFSKSKLVVVGAVGVKKCDISLQFF; (SEQ ID NO: 169)

FDLGGGTFDVKLVVVGAVGVKSTAGDTHLG; or (SEQ ID NO: 170)

CLLLHYSVSKKLVVVGAVGVATFYVAVTVP. (SEQ ID NO: 171)

In some embodiments, (Xaa)N comprises an amino acid sequence of

IDIIMKIRNA, (SEQ ID NO: 172)

FFFFFFFFFFFFFFFFFFFFIIFFIFFWMC, (SEQ ID NO: 173)

FFFFFFFFFFFFFFFFFFFFFFFAAFWFW, (SEQ ID NO: 174)

IFFIFFIIFFFFFFFFFFFIIIIIIIWEC, (SEQ ID NO: 175)

FIFFFIIFFFFFIFFFFFIFIIIIIIFWEC, (SEQ ID NO: 176)

TEY, WQAGILAR, (SEQ ID NO: 177)

HSYTTAE, (SEQ ID NO: 178)

PLTEEKIK, (SEQ ID NO: 179)

GALHFKPGSR, (SEQ ID NO: 180)

RRANKDATAE, (SEQ ID NO: 181)

KAFISHEEKR, (SEQ ID NO: 182)

TDLSSRFSKS, (SEQ ID NO: 183)

FDLGGGTFDV, (SEQ ID NO: 184)

CLLLHYSVSK, or (SEQ ID NO: 185)

MTEYKLVVV. (SEQ ID NO: 186)

In some embodiments, (XaaC)C comprises an amino acid sequence of

KKNKKDDIKD, (SEQ ID NO: 187)

AGNDDDDDDDDDDDDDDDDDDKKDKDDDDDD, (SEQ ID NO: 188)

AGNKKKKKKKNNNNNNNNNNNNNNNNNNNN, (SEQ ID NO: 189)

AGRDDDDDDDDDDDDDDDDDDDDDDDDDD, (SEQ ID NO: 190)

GKSALTIQL, (SEQ ID NO: 191)

GKSALTI, (SEQ ID NO: 192)

QGQNLKYQ, (SEQ ID NO: 193)

ILGVLLLI, (SEQ ID NO: 194)

EKEGKISK, (SEQ ID NO: 195)

AASDFIFLVT, (SEQ ID NO: 196)

KELKQVASPF, (SEQ ID NO: 197)

KKKLINEKKE, (SEQ ID NO: 198)

KKCDISLQFF, (SEQ ID NO: 199)

KSTAGDTHLG, (SEQ ID NO: 200)

ATFYVAVTVP, (SEQ ID NO: 201)

LTIQLIQNHFVDEYDPTIEDSYRKQVVIDG, or (SEQ ID NO: 202)

TIQLIQNHFVDEYDPTIEDSYRKQVVIDGE. (SEQ ID NO: 203)

In some embodiments, a first mutant RAS peptide sequence comprises a first neoepitope of a mutant RAS protein and a second mutant RAS peptide sequence comprises a second neoepitope of a mutant RAS protein, wherein the first mutant RAS peptide sequence is different from the mutant RAS peptide sequence, and wherein the first neoepitope comprises at least one mutant amino acid and the second neoepitope comprises the same mutant amino acid.

In some embodiments, at least one of the mutant RAS peptide sequences comprises a mutant amino acid not encoded by the genome of a cancer cell of a subject.

In some embodiments, each of the mutant RAS peptide sequences are present at a concentration at least 1 μg/mL, at least 10 μg/mL, at least 25 μg/mL, at least 50 μg/mL, or at least 100 μg/mL.

In some embodiments, each of the mutant RAS peptide sequences are present at a concentration at most 5000 μg/mL, at most 2500 μg/mL, at most 1000 μg/mL, at most 750 μg/mL, at most 500 μg/mL, at most 400 μg/mL, or at most 300 μg/mL.

In some embodiments, each of the mutant RAS peptide sequences are present at a concentration of from 10 μg/mL to 5000 μg/mL, 10 μg/mL to 4000 μg/mL, 10 μg/mL to 3000 μg/mL, 10 μg/mL to 2000 μg/mL, g/mL to 1000 μg/mL, 25 μg/mL to 500 μg/mL, or 50 μg/mL to 300 μg/mL.

In some embodiments, the composition further comprises different mutant RAS peptide sequence with a G13A, G13C, G13D, G13R, G13S, G13V, G12A, G12C, G12D, G12R, G12S, G12V or a Q61 mutation.

In some embodiments, the composition further comprises an immunomodulatory agent or an adjuvant.

In some embodiments, the adjuvant is polyICLC.

In some aspects, provided herein is a pharmaceutical composition comprising: a composition described herein and a pharmaceutically acceptable excipient.

In some embodiments, the pharmaceutical composition comprises a pH modifier present at a concentration of less than 1 mM or greater than 1 mM.

In some embodiments, the pharmaceutical composition is a vaccine composition.

In some embodiments, the pharmaceutical composition is aqueous.

In some embodiments, one or more of the at least one polypeptide is bounded by pI>5 and HYDRO>−6, pI>8 and HYDRO>−8, pI<5 and HYDRO>−5, pI>9 and HYDRO<−8, pI>7 and a HYDRO value of >−5.5, pI<4.3 and −4≥HYDRO≥−8, pI>0 and HYDRO<−8, pI>0 and HYDRO>−4, or pI>4.3 and −4≥HYDRO≥−8, pI>0 and HYDRO>−4, or pI>4.3 and HYDRO≤−4., pI>0 and HYDRO>−4, or pI>4.3 and −4≥HYDRO≥−9, 5≥pI≥12 and −4≥HYDRO≥−9.

In some embodiments, the pH modifier is a base.

In some embodiments, the pH modifier is a conjugate base of a weak acid.

In some embodiments, the pH modifier is a pharmaceutically acceptable salt.

In some embodiments, the pH modifier is a dicarboxylate or tricarboxylate salt.

In some embodiments, the pH modifier is citric acid and/or a citrate salt.

In some embodiments, the citrate salt is disodium citrate and/or trisodium citrate.

In some embodiments, the pH modifier is succinic acid and/or a succinate salt.

In some embodiments, the succinate salt is a disodium succinate and/or a monosodium succinate.

In some embodiments, the succinate salt is disodium succinate hexahydrate.

In some embodiments, the pH modifier is present at a concentration of from 0.1 mM-1 mM.

In some embodiments, the pharmaceutically acceptable carrier comprises a liquid.

In some embodiments, the pharmaceutically acceptable carrier comprises water.

In some embodiments, the pharmaceutically acceptable carrier comprises a sugar.

In some embodiments, the sugar comprises dextrose or mannitol.

In some embodiments, the dextrose is present at a concentration of from 1-10% w/v.

In some embodiments, the sugar comprises trehalose.

In some embodiments, the sugar comprises sucrose.

In some embodiments, the pharmaceutically acceptable carrier comprises dimethyl sulfoxide (DMSO).

In some embodiments, the DMSO is present at a concentration from 0.1% to 10%, 0.5% to 5%, or 1% to 3%.

In some embodiments, the pharmaceutically acceptable carrier does not comprise dimethyl sulfoxide (DMSO).

In some embodiments, the pharmaceutical composition is lyophilizable.

In some embodiments, the pharmaceutical composition further comprises an immunomodulator or adjuvant.

In some embodiments, the immunomodulator or adjuvant is selected from the group consisting of poly-ICLC, 1018ISS, aluminum salts, Amplivax, AS15, BCG, CP-870, 893, CpG7909, CyaA, ARNAX, STING agonists, dSLIM, GM-CSF, FLT-3L, IC30, IC31, Imiquimod, ImuFact IMP321, IS Patch, ISS, ISCOMATRIX, Juvlmmune, Lipo-Vac, MF59, monophosphoryllipid A, Montanide IMS 1312, Montanide ISA 206, Montanide ISA 50V, Montanide ISA-51, OK-432, OM-174, OM-197-MP-EC, ONTAK, PepTel®, vector system, PLGA microparticles, resiquimod, SRL172, Virosomes and other Virus-like particles, YF-17D, VEGF trap, R848, beta-glucan, Pam3Cys, and Aquila's QS21 stimulon.

In some embodiments, the immunomodulator or adjuvant comprises poly-ICLC.

In some embodiments, a ratio of poly-ICLC to peptides in the pharmaceutical composition is from 2:1 to 1:10 v:v.

In some embodiments, the ratio of poly-ICLC to peptides in the pharmaceutical composition is about 1:1, 1:2, 1:3, 1:4 or 1:5 v:v.

In some embodiments, the ratio of poly-ICLC to peptides in the pharmaceutical composition is about 1:3 v:v.

In some aspects, provided herein is a method of treating a subject with cancer comprising administering to the subject a pharmaceutical composition described herein.

In some aspects, provided herein is a method of treating a subject with cancer comprising administering to the subject a peptide with a sequence of

VVGADGVGK, (SEQ ID NO: 204)

VVGACGVGK, (SEQ ID NO: 205)

VVGAVGVGK, (SEQ ID NO: 206)

VVVGADGVGK, (SEQ ID NO: 207)

VVVGACGVGK, (SEQ ID NO: 208)

VVVGAVGVGK, (SEQ ID NO: 209)

wherein the subject expresses a protein encoded by an HLA-A02:01 allele, an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, an HLA-A74:01 allele, or an HLA-C08:02 allele of the subject's genome.

In some aspects, provided herein is a method of treating a subject with cancer comprising administering to the subject a mutant RAS peptide or a nucleic acid encoding the mutant RAS peptide, wherein the mutant RAS peptide comprises at least 8 contiguous amino acids of a mutant RAS protein comprising a mutation at G12, wherein the peptide comprises the mutation at G12 and binds to HLA-A11:01 or HLA-A03:01, wherein the subject is identified as expressing a protein encoded by an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, or an HLA-A74:01 allele.

In some aspects, provided herein is a method of treating a subject with cancer comprising administration to the subject a peptide comprising a sequence

GADGVGKSAL, (SEQ ID NO: 210)

GACGVGKSA, or (SEQ ID NO: 214)

GAVGVGKSA; (SEQ ID NO: 215)

GACGVGKSAL, (SEQ ID NO: 211)

GAVGVGKSAL, (SEQ ID NO: 212)

GADGVGKSA, (SEQ ID NO: 213)

wherein the subject expresses a protein encoded by an HLA-A02:01 allele, an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, an HLA-A74:01 allele, or an HLA-C08:02 allele of the subject's genome that binds to the peptide.

In some aspects, provided herein is a method of treating a subject with cancer comprising administering to the subject a first and a second peptide or a nucleic acid encoding the first and second peptide, wherein the first and second peptides comprise at least two of:

(1)

KLVVVGADGV, (SEQ ID NO: 216)

KLVVVGACGV, (SEQ ID NO: 217)

KLVVVGAVGV, (SEQ ID NO: 218)

LVVVGADGV, (SEQ ID NO: 219)

LVVVGACGV, (SEQ ID NO: 220)

LVVVGAVGV; (SEQ ID NO: 221)

(2)

GADGVGKSAL, (SEQ ID NO: 222)

GACGVGKSAL, (SEQ ID NO: 223)

GAVGVGKSAL, (SEQ ID NO: 224)

GADGVGKSA, (SEQ ID NO: 225)

GACGVGKSA, (SEQ ID NO: 226)

GAVGVGKSA; and (SEQ ID NO: 227)

(3)

VVGADGVGK, (SEQ ID NO: 228)

VVGACGVGK, (SEQ ID NO: 229)

VVGAVGVGK, (SEQ ID NO: 230)

VVVGADGVGK, (SEQ ID NO: 231)

VVVGACGVGK, (SEQ ID NO: 232)

VVVGAVGVGK; (SEQ ID NO: 233)

wherein the subject's HLA allele expression is unknown at the time of administration.

In some aspects, provided herein is a method of treating a subject with cancer comprising administering to the subject a mutant RAS peptide or a nucleic acid encoding the mutant RAS peptide, wherein the mutant RAS peptide comprises at least 8 contiguous amino acids of a mutant RAS protein comprising a G12C mutation, wherein the peptide comprises the G12C mutation, and further wherein the peptide comprises a stabilizing mutation not encoded by a genome of a cancer cell, wherein the subject expresses a protein encoded by an HLA-A02:01 allele, an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, an HLA-A74:01 allele, or an HLA-C08:02 allele.

In some aspects, provided herein is a method of identifying a subject with cancer as a candidate for a therapeutic, the method comprising identifying the subject as a subject that expresses a protein encoded by an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, or an HLA-A74:01 allele, wherein the therapeutic is a mutant RAS peptide or a nucleic acid encoding the mutant RAS peptide, wherein the mutant RAS peptide comprises at least 8 contiguous amino acids of a mutant RAS protein comprising a mutation at G12, wherein the peptide comprises the mutation at G12 and binds to a protein encoded by an HLA-A03:01 allele, an HLA-A11:01 allele, an HLA-A03:02 allele, an HLA-A30:01 allele, an HLA-A31:01 allele, an HLA-A33:01 allele, an HLA-A33:03 allele, an HLA-A68:01 allele, or an HLA-A74:01 allele.

In some embodiments, the method further comprises administering the therapeutic to the subject.

In some aspects, provided herein is a method of treating a subject with cancer, the method comprising: (a) identifying a first protein expressed by the subject, wherein the first protein is encoded by a first HLA allele of the subject and wherein the first HLA allele is an HLA allele provided in any one of Tables 1 to 14; and (b) administering to the subject (i) a first mutant RAS peptide, wherein the first mutant RAS peptide is a peptide to the first HLA allele provided in any one of Tables 1 to 14, or (ii) a polynucleic acid encoding the first mutant RAS peptide.

In some embodiments, the method further comprises identifying a second protein expressed by the subject, wherein the second protein is encoded by a second HLA allele of the subject and wherein the second HLA allele is an HLA allele provided in any one of Tables 1 to 14.

In some embodiments, the method further comprises administering to the subject (i) a second mutant RAS peptide, wherein the second mutant RAS peptide is a peptide to the second HLA allele provided in any one of Tables 1 to 14, or (ii) a polynucleic acid encoding the second mutant RAS peptide.

In some embodiments, the first HLA allele is different from the second HLA allele.

In some embodiments, the first mutant RAS peptide is different from the second mutant RAS peptide.

For example, in some embodiments, the first protein expressed by a subject is encoded by HLA-A03:01 as provided, e.g., in Table 11, and the method comprises administering to the subject a first mutant RAS peptide comprising a sequence of

VVGASGVGK (SEQ ID NO: 234)

or a polynucleic acid encoding the first mutant RAS peptide.

For example, in some embodiments, the first protein expressed by a subject is encoded by HLA-A03:01 as provided, e.g., in Table 5, and the method comprises administering to the subject a first mutant RAS peptide comprising a sequence of

CLLDILDTAGK (SEQ ID NO: 235)

or a polynucleic acid encoding the first mutant RAS peptide.

For another example, in some embodiments, the second protein expressed by a subject is encoded by HLA-A11:01 as provided, e.g., in Table 11, and the method comprises administering to the subject a second mutant RAS peptide comprising a sequence of

VVVGASGVGK (SEQ ID NO: 236)

or a polynucleic acid encoding the second mutant RAS peptide.

For yet another example, in some embodiments, the second protein expressed by a subject is encoded by HLA-C08:02 as provided, e.g., in Table 9, and the method comprises administering to the subject a second mutant RAS peptide comprising a sequence of

GADGVGKSAL (SEQ ID NO: 237)

or a polynucleic acid encoding the second mutant RAS peptide.

In some embodiments, an immune response is elicited in the subject.

In some embodiments, the immune response is a humoral response.

In some embodiments, the mutant RAS peptide sequences are administered simultaneously, separately or sequentially.

In some embodiments, the first peptide is sequentially administered after a time period sufficient for the second peptide to activate the second T cells.

In some embodiments, the cancer is selected from the group consisting of lung cancer, non-small cell lung cancer, pancreatic cancer, colorectal cancer, uterine cancer and liver cancer.

In some embodiments, the method further comprises comprising administering at least one additional therapeutic agent or modality.

In some embodiments, the at least one additional therapeutic agent or modality is surgery, a checkpoint inhibitor, an antibody or fragment thereof, a chemotherapeutic agent, radiation, a vaccine, a small molecule, a T cell, a vector, and APC, a polynucleotide, an oncolytic virus or any combination thereof.

In some embodiments, the at least one additional therapeutic agent is an anti-PD-1 agent and anti-PD-L1 agent, an anti-CTLA-4 agent, or an anti-CD40 agent.

In some embodiments, the additional therapeutic agent is administered before, simultaneously, or after administering the mutant RAS peptide sequences.

BRIEF DESCRIPTION OF THE DRAWINGS

The features of the present disclosure are set forth with particularity in the appended claims. A better understanding of the features and advantages of the present will be obtained by reference to the following detailed description that sets forth illustrative embodiments, in which the principles of the disclosure are utilized, and the accompanying drawings of which:

FIGS. 2A and 2B illustrate a summary of experiments showing that predicted RAS G12C epitopes to HLA-A11:01 (left), and RAS G12V epitopes to HLA-A11:01 (right) can be detected by mass spectrometry. FIG. 2A discloses SEQ ID NOS 2540-2544 and FIG. 2B discloses SEQ ID NOS 2545-2565, all respectively, in order of appearance.

FIG. 3C discloses SEQ ID NOS 2566 and 2567, respectively, in order of appearance.

FIGS. 5E-5H demonstrate antigen-specific cytotoxicity activity of T cells expressing a TCR specific to mutant RAS peptides. The data shows that RAS specific TCRs can elicit specific recognition of cells carrying the mutated peptide and the proper MHC-I and upregulate cytotoxic machinery.

DETAILED DESCRIPTION

Figure 1:
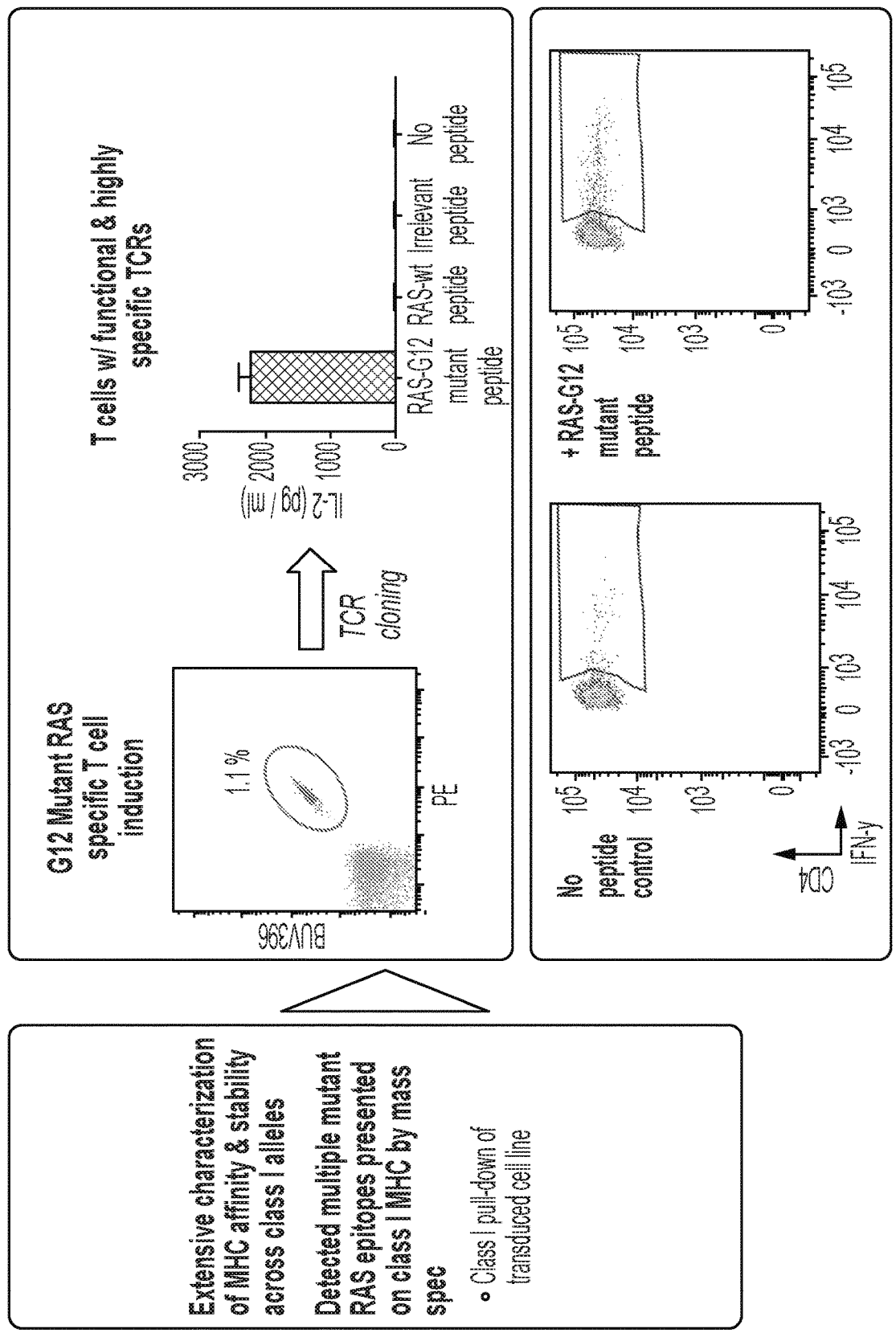
FIG. 1 illustrates an exemplary workflow for determination of RAS epitopes that can induce CD8+ and/or CD4+ T cells.

Described herein are new immunotherapeutic agents and uses thereof based on the discovery of neoantigens arising from mutational events unique to an individual's tumor. Accordingly, the present disclosure described herein provides peptides, polynucleotides encoding the peptides, and peptide binding agents that can be used, for example, to stimulate an immune response to a tumor associated antigen or neoepitope, to create an immunogenic composition or cancer vaccine for use in treating disease.

The following description and examples illustrate embodiments of the present disclosure in detail. It is to be understood that this present disclosure is not limited to the particular embodiments described herein and as such can vary. Those of skill in the art will recognize that there are numerous variations and modifications of this present disclosure, which are encompassed within its scope.

All terms are intended to be understood as they would be understood by a person skilled in the art. Unless defined otherwise, all technical and scientific terms used herein have the same meaning as commonly understood by one of ordinary skill in the art to which the disclosure pertains.

The section headings used herein are for organizational purposes only and are not to be construed as limiting the subject matter described.

Although various features of the present disclosure may be described in the context of a single embodiment, the features may also be provided separately or in any suitable combination. Conversely, although the present disclosure may be described herein in the context of separate embodiments for clarity, the present disclosure may also be implemented in a single embodiment.

The following definitions supplement those in the art and are directed to the current application and are not to be imputed to any related or unrelated case, e.g., to any commonly owned patent or application. Although any methods and materials similar or equivalent to those described herein can be used in the practice for testing of the present disclosure, the preferred materials and methods are described herein. Accordingly, the terminology used herein is for the purpose of describing particular embodiments only, and is not intended to be limiting.

I. Definitions

The terminology used herein is for the purpose of describing particular cases only and is not intended to be limiting. In this application, the use of the singular includes the plural unless specifically stated otherwise. As used herein, the singular forms "a", "an" and "the" are intended to include the plural forms as well, unless the context clearly indicates otherwise.

In this application, the use of "or" means "and/or" unless stated otherwise. The terms "and/or" and "any combination thereof" and their grammatical equivalents as used herein, can be used interchangeably. These terms can convey that any combination is specifically contemplated. Solely for illustrative purposes, the following phrases "A, B, and/or C" or "A, B, C, or any combination thereof" can mean "A individually; B individually; C individually; A and B; B and C; A and C; and A, B, and C." The term "or" can be used conjunctively or disjunctively, unless the context specifically refers to a disjunctive use.

The term "about" or "approximately" can mean within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, within 5-fold, and more preferably within 2-fold, of a value. Where particular values are described in the application and claims, unless otherwise stated the term "about" meaning within an acceptable error range for the particular value should be assumed.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the present disclosure, and vice versa. Furthermore, compositions of the present disclosure can be used to achieve methods of the present disclosure.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the present disclosures. To facilitate an understanding of the present disclosure, a number of terms and phrases are defined below.

"Major Histocompatibility Complex" or "MHC" is a cluster of genes that plays a role in control of the cellular interactions responsible for physiologic immune responses. In humans, the MHC complex is also known as the human leukocyte antigen (HLA) complex. For a detailed description of the MHC and HLA complexes, see, Paul, Fundamental Immunology, $3^{rd}$ Ed., Raven Press, New York (1993). "Proteins or molecules of the major histocompatibility complex (MHC)", "MHC molecules", "MHC proteins" or "HLA proteins" are to be understood as meaning proteins capable of binding peptides resulting from the proteolytic cleavage of protein antigens and representing potential lymphocyte epitopes, (e.g., T cell epitope and B cell epitope) transporting them to the cell surface and presenting them there to specific cells, in particular cytotoxic T-lymphocytes, T-helper cells, or B cells. The major histocompatibility complex in the genome comprises the genetic region whose gene products expressed on the cell surface are important for binding and presenting endogenous and/or foreign antigens and thus for regulating immunological processes. The major histocompatibility complex is classified into two gene groups coding for different proteins, namely molecules of MHC class I and molecules of MHC class II. The cellular biology and the expression patterns of the two MHC classes are adapted to these different roles.

"Human Leukocyte Antigen" or "HLA" is a human class I or class II Major Histocompatibility Complex (MHC) protein (see, e.g., Stites, et al., Immunology, $8^{th}$ Ed., Lange Publishing, Los Altos, Calif. (1994).

"Polypeptide", "peptide" and their grammatical equivalents as used herein refer to a polymer of amino acid residues, typically L-amino acids, connected one to the other, typically by peptide bonds between the α-amino and carboxyl groups of adjacent amino acids. Polypeptides and peptides include, but are not limited to, mutant peptides, "neoantigen peptides" and "neoantigenic peptides". Polypeptides or peptides can be a variety of lengths, either in their neutral (uncharged) forms or in forms which are salts, and either free of modifications such as glycosylation, side chain oxidation, or phosphorylation or containing these modifications, subject to the condition that the modification not destroy the biological activity of the polypeptides as herein described. A "mature protein" is a protein which is full-length and which, optionally, includes glycosylation or other modifications typical for the protein in a given cellular environment. Polypeptides and proteins disclosed herein (including functional portions and functional variants thereof) can comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, ornithine, α-aminocyclopentane carboxylic acid, α-aminocyclohexane carboxylic acid, α-aminocycloheptane carboxylic acid, α-(2-amino-2-norbornane)-carboxylic acid, α,γ-diaminobutyric acid, α,β-diaminopropionic acid, homophenylalanine, and α-tert-butylglycine. The present disclosure further contemplates that expression of polypeptides described herein in an engineered cell can be associated with post-translational modifications of one or more amino acids of the polypeptide constructs. Non-limiting examples of post-translational modifications include phosphorylation, acylation including acetylation and formylation, glycosylation (including N-linked and O-linked), amidation, hydroxylation, alkylation including methylation and ethylation, ubiquitination, addition of pyrrolidone carboxylic acid, formation of disulfide bridges, sulfation, myristoylation, palmitoylation, isoprenylation, farnesylation, geranylation, glypiation, lipoylation and iodination.

A peptide or polypeptide may comprise at least one flanking sequence. The term "flanking sequence" as used herein refers to a fragment or region of a peptide that is not a part of an epitope.

An "immunogenic" peptide or an "immunogenic" epitope or "peptide epitope" is a peptide that comprises an allele-specific motif such that the peptide will bind an HLA molecule and induce a cell-mediated or humoral response, for example, cytotoxic T lymphocyte (CTL (e.g., CD8$^+$)), helper T lymphocyte (Th (e.g., CD4$^+$)) and/or B lymphocyte response. Thus, immunogenic peptides described herein are capable of binding to an appropriate HLA molecule and thereafter inducing a CTL (cytotoxic) response, or a HTL (and humoral) response, to the peptide.

"Neoantigen" means a class of tumor antigens which arise from tumor-specific changes in proteins. Neoantigens encompass, but are not limited to, tumor antigens which arise from, for example, substitution in the protein sequence, frame shift mutation, fusion polypeptide, in-frame deletion, insertion, expression of endogenous retroviral polypeptides, and tumor-specific overexpression of polypeptides.

The term "residue" refers to an amino acid residue or amino acid mimetic residue incorporated into a peptide or protein by an amide bond or amide bond mimetic, or nucleic acid (DNA or RNA) that encodes the amino acid or amino acid mimetic.

A "neoepitope", "tumor specific neoepitope" or "tumor antigen" refers to an epitope or antigenic determinant region that is not present in a reference, such as a non-diseased cell, e.g., a non-cancerous cell or a germline cell, but is found in a diseased cell, e.g., a cancer cell. This includes situations where a corresponding epitope is found in a normal non-diseased cell or a germline cell but, due to one or more mutations in a diseased cell, e.g., a cancer cell, the sequence of the epitope is changed so as to result in the neoepitope. The term "neoepitope" as used herein refers to an antigenic determinant region within the peptide or neoantigenic peptide. A neoepitope may comprise at least one "anchor residue" and at least one "anchor residue flanking region." A neoepitope may further comprise a "separation region." The term "anchor residue" refers to an amino acid residue that binds to specific pockets on HLAs, resulting in specificity of interactions with HLAs. In some cases, an anchor residue may be at a canonical anchor position. In other cases, an anchor residue may be at a non-canonical anchor position. Neoepitopes may bind to HLA molecules through primary and secondary anchor residues protruding into the pockets in the peptide-binding grooves. In the peptide-binding grooves, specific amino acids compose pockets that accommodate the corresponding side chains of the anchor residues of the presented neoepitopes. Peptide-binding preferences exist among different alleles of both of HLA I and HLA II molecules. HLA class I molecules bind short neoepitopes, whose N- and C-terminal ends are anchored into the pockets located at the ends of the neoepitope binding groove. While the majority of the HLA class I binding neoepitopes are of about 9 amino acids, longer neoepitopes can be accommodated by the bulging of their central portion, resulting in binding neoepitopes of about 8 to 12 amino acids. Neoepitopes binding to HLA class II proteins are not constrained in size and can vary from about 16 to 25 amino acids. The neoepitope binding groove in the HLA class II molecules is open at both ends, which enables binding of peptides with relatively longer length. Though the core 9 amino acid residues long segment contributes the most to the recognition of the neoepitope, the anchor residue flanking regions are also important for the specificity of the peptide to the HLA class II allele. In some cases, the anchor residue flanking region is N-terminus residues. In another case, the anchor residue flanking region is C-terminus residues. In yet another case, the anchor residue flanking region is both N-terminus residues and C-terminus residues. In some cases, the anchor residue flanking region is flanked by at least two anchor residues. An anchor residue flanking region flanked by anchor residues is a "separation region."

A "reference" can be used to correlate and compare the results obtained in the methods of the present disclosure from a tumor specimen. Typically the "reference" may be obtained on the basis of one or more normal specimens, in particular specimens which are not affected by a cancer disease, either obtained from a patient or one or more different individuals, for example, healthy individuals, in particular individuals of the same species. A "reference" can be determined empirically by testing a sufficiently large number of normal specimens.

An "epitope" is the collective features of a molecule, such as primary, secondary and tertiary peptide structure, and charge, that together form a site recognized by, for example, an immunoglobulin, T cell receptor, HLA molecule, or chimeric antigen receptor. Alternatively, an epitope can be defined as a set of amino acid residues which is involved in recognition by a particular immunoglobulin, or in the context of T cells, those residues necessary for recognition by T cell receptor proteins, chimeric antigen receptors, and/or Major Histocompatibility Complex (MHC) receptors. A "T cell epitope" is to be understood as meaning a peptide sequence which can be bound by the MHC molecules of class I or II in the form of a peptide-presenting MHC molecule or MHC complex and then, in this form, be recognized and bound by T cells, such as T-lymphocytes or T-helper cells. Epitopes can be prepared by isolation from a natural source, or they can be synthesized according to standard protocols in the art. Synthetic epitopes can comprise artificial amino acid residues, "amino acid mimetics," such as D isomers of naturally-occurring L amino acid residues or non-naturally-occurring amino acid residues such as cyclohexylalanine. Throughout this disclosure, epitopes may be referred to in some cases as peptides or peptide epitopes. It is to be appreciated that proteins or peptides that comprise an epitope or an analog described herein as well as additional amino acid(s) are still within the bounds of the present disclosure. In certain embodiments, the peptide comprises a fragment of an antigen. In certain embodiments, there is a limitation on the length of a peptide of the present disclosure. The embodiment that is length-limited occurs when the protein or peptide comprising an epitope described herein comprises a region (i.e., a contiguous series of amino acid residues) having 100% identity with a native sequence. In order to avoid the definition of epitope from reading, e.g., on whole natural molecules, there is a limitation on the length of any region that has 100% identity with a native peptide sequence. Thus, for a peptide comprising an epitope described herein and a region with 100% identity with a native peptide sequence, the region with 100% identity to a native sequence generally has a length of: less than or equal to 600 amino acid residues, less than or equal to 500 amino acid residues, less than or equal to 400 amino acid residues, less than or equal to 250 amino acid residues, less than or equal to 100 amino acid residues, less than or equal to 85 amino acid residues, less than or equal to 75 amino acid residues, less than or equal to 65 amino acid residues, and less than or equal to 50 amino acid residues. In certain embodiments, an "epitope" described herein is comprised by a peptide having a region with less than 51 amino acid residues that has 100% identity to a native peptide sequence, in any increment down to 5 amino acid residues; for example 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2 or 1 amino acid residues.

The nomenclature used to describe peptides or proteins follows the conventional practice wherein the amino group is presented to the left (the amino- or N-terminus) and the carboxyl group to the right (the carboxy- or C-terminus) of each amino acid residue. When amino acid residue positions are referred to in a peptide epitope they are numbered in an amino to carboxyl direction with position one being the residue located at the amino terminal end of the epitope, or the peptide or protein of which it can be a part. In the formula representing selected specific embodiments of the present disclosure, the amino- and carboxyl-terminal groups, although not specifically shown, are in the form they would assume at physiologic pH values, unless otherwise specified. In the amino acid structure formula, each residue is generally represented by standard three letter or single letter designations. The L-form of an amino acid residue is represented by a capital single letter or a capital first letter of a three-letter symbol, and the D-form for those amino acid residues having D-forms is represented by a lower case single letter or a lower case three letter symbol. However, when three letter symbols or full names are used without capitals, they can refer to L amino acid residues. Glycine has no asymmetric carbon atom and is simply referred to as "Gly" or "G". The amino acid sequences of peptides set forth herein are generally designated using the standard single letter symbol. (A, Alanine; C, Cysteine; D, Aspartic Acid; E, Glutamic Acid; F, Phenylalanine; G, Glycine; H, Histidine; I, Isoleucine; K, Lysine; L, Leucine; M, Methionine; N, Asparagine; P, Proline; Q, Glutamine; R, Arginine; S, Serine; T, Threonine; V, Valine; W, Tryptophan; and Y, Tyrosine.)

The term "mutation" refers to a change of or difference in the nucleic acid sequence (nucleotide substitution, addition or deletion) compared to a reference. A "somatic mutation" can occur in any of the cells of the body except the germ cells (sperm and egg) and therefore are not passed on to children. These alterations can (but do not always) cause cancer or other diseases. In some embodiments, a mutation is a non-synonymous mutation. The term "non-synonymous mutation" refers to a mutation, for example, a nucleotide substitution, which does result in an amino acid change such as an amino acid substitution in the translation product. A "frameshift" occurs when a mutation disrupts the normal phase of a gene's codon periodicity (also known as "reading frame"), resulting in the translation of a non-native protein sequence. It is possible for different mutations in a gene to achieve the same altered reading frame.

A "conservative" amino acid substitution is one in which one amino acid residue is replaced with another amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). For example, substitution of a phenylalanine for a tyrosine is a conservative substitution. Methods of identifying nucleotide and amino acid conservative substitutions which do not eliminate peptide function are well-known in the art.

As used herein, the term "affinity" refers to a measure of the strength of binding between two members of a binding pair, for example, an HLA-binding peptide and a class I or II HLA. $K_D$ is the dissociation constant and has units of molarity. The affinity constant is the inverse of the dissociation constant. An affinity constant is sometimes used as a generic term to describe this chemical entity. It is a direct measure of the energy of binding. Affinity may be determined experimentally, for example by surface plasmon resonance (SPR) using commercially available Biacore SPR units. Affinity may also be expressed as the inhibitory concentration 50 ($IC_{50}$), that concentration at which 50% of the peptide is displaced. Likewise, $\ln(IC_{50})$ refers to the natural log of the $IC_{50}$. $K_{off}$ refers to the off-rate constant, for example, for dissociation of an HLA-binding peptide and a class I or II HLA. Throughout this disclosure, "binding data" results can be expressed in terms of "$IC_{50}$." $IC_{50}$ is the concentration of the tested peptide in a binding assay at which 50% inhibition of binding of a labeled reference peptide is observed. Given the conditions in which the assays are run (i.e., limiting HLA protein and labeled reference peptide concentrations), these values approximate $K_D$ values. Assays for determining binding are well known in the art and are described in detail, for example, in PCT publications WO 94/20127 and WO 94/03205, and other publications such Sidney et al., Current Protocols in Immunology 18.3.1 (1998); Sidney, et al., J. Immunol. 154:247 (1995); and Sette, et al., Mol. Immunol. 31:813 (1994). Alternatively, binding can be expressed relative to binding by a reference standard peptide. For example, can be based on its $IC_{50}$, relative to the $IC_{50}$ of a reference standard peptide. Binding can also be determined using other assay systems including those using: live cells (e.g., Ceppellini et al., Nature 339:392 (1989); Christnick et al., Nature 352:67 (1991); Busch et al., Int. Immunol. 2:443 (1990); Hill et al., J. Immunol. 147:189 (1991); del Guercio et al., J. Immunol. 154:685 (1995)), cell free systems using detergent lysates (e.g., Cerundolo et al., J. Immunol. 21:2069 (1991)), immobilized purified MHC (e.g., Hill et al., J. Immunol. 152, 2890 (1994); Marshall et al., J. Immunol. 152:4946 (1994)), ELISA systems (e.g., Reay et al., EMBO J. 11:2829 (1992)), surface plasmon resonance (e.g., Khilko et al., J. Biol. Chem. 268:15425 (1993)); high flux soluble phase assays (Hammer et al., J. Exp. Med. 180:2353 (1994)), and measurement of class I MHC stabilization or assembly (e.g., Ljunggren et al., Nature 346:476 (1990); Schumacher et al., Cell 62:563 (1990); Townsend et al., Cell 62:285 (1990); Parker et al., J. Immunol. 149:1896 (1992)). "Cross-reactive binding" indicates that a peptide is bound by more than one HLA molecule; a synonym is degenerate binding.

The term "derived" and its grammatical equivalents when used to discuss an epitope is a synonym for "prepared" and its grammatical equivalents. A derived epitope can be isolated from a natural source, or it can be synthesized according to standard protocols in the art. Synthetic epitopes can comprise artificial amino acid residues "amino acid mimetics," such as D isomers of natural occurring L amino acid residues or non-natural amino acid residues such as cyclohexylalanine. A derived or prepared epitope can be an analog of a native epitope.

A "native" or a "wild type" sequence refers to a sequence found in nature. Such a sequence can comprise a longer sequence in nature.

A "receptor" is to be understood as meaning a biological molecule or a molecule grouping capable of binding a ligand. A receptor may serve, to transmit information in a cell, a cell formation or an organism. The receptor comprises at least one receptor unit, for example, where each receptor unit may consist of a protein molecule. The receptor has a structure which complements that of a ligand and may complex the ligand as a binding partner. The information is transmitted in particular by conformational changes of the receptor following complexation of the ligand on the surface of a cell. In some embodiments, a receptor is to be understood as meaning in particular proteins of MHC classes I and II capable of forming a receptor/ligand complex with a ligand, in particular a peptide or peptide fragment of suitable length.

A "ligand" is to be understood as meaning a molecule which has a structure complementary to that of a receptor and is capable of forming a complex with this receptor. In some embodiments, a ligand is to be understood as meaning a peptide or peptide fragment which has a suitable length and suitable binding motifs in its amino acid sequence, so that the peptide or peptide fragment is capable of forming a complex with proteins of MHC class I or MHC class II.

In some embodiments, a "receptor/ligand complex" is also to be understood as meaning a "receptor/peptide complex" or "receptor/peptide fragment complex", including a peptide- or peptide fragment-presenting MHC molecule of class I or of class II.

"Synthetic peptide" refers to a peptide that is obtained from a non-natural source, e.g., is man-made. Such peptides can be produced using such methods as chemical synthesis or recombinant DNA technology. "Synthetic peptides" include "fusion proteins."

The term "motif" refers to a pattern of residues in an amino acid sequence of defined length, for example, a peptide of less than about 15 amino acid residues in length, or less than about 13 amino acid residues in length, for example, from about 8 to about 13 amino acid residues (e.g., 8, 9, 10, 11, 12, or 13) for a class I HLA motif and from about 6 to about 25 amino acid residues (e.g., 6, 7, 8, 9, 10, 11, 12, 13, 14, 15, 16, 17, 18, 19, 20, 21, 22, 23, 24, or 25) for a class II HLA motif, which is recognized by a particular HLA molecule. Motifs are typically different for each HLA protein encoded by a given human HLA allele. These motifs differ in their pattern of the primary and secondary anchor residues. In some embodiments, an MHC class I motif identifies a peptide of 9, 10, or 11 amino acid residues in length.

The term "naturally occurring" and its grammatical equivalents as used herein refer to the fact that an object can be found in nature. For example, a peptide or nucleic acid that is present in an organism (including viruses) and can be isolated from a source in nature and which has not been intentionally modified by man in the laboratory is naturally occurring.

According to the present disclosure, the term "vaccine" relates to a pharmaceutical preparation (pharmaceutical composition) or product that upon administration induces an immune response, for example, a cellular or humoral immune response, which recognizes and attacks a pathogen or a diseased cell such as a cancer cell. A vaccine may be used for the prevention or treatment of a disease. The term "individualized cancer vaccine" or "personalized cancer vaccine" concerns a particular cancer patient and means that a cancer vaccine is adapted to the needs or special circumstances of an individual cancer patient.

A "protective immune response" or "therapeutic immune response" refers to a CTL and/or an HTL response to an antigen derived from an pathogenic antigen (e.g., a tumor antigen), which in some way prevents or at least partially arrests disease symptoms, side effects or progression. The immune response can also include an antibody response which has been facilitated by the stimulation of helper T cells.

"Antigen processing" or "processing" and its grammatical equivalents refers to the degradation of a polypeptide or antigen into procession products, which are fragments of said polypeptide or antigen (e.g., the degradation of a polypeptide into peptides) and the association of one or more of these fragments (e.g., via binding) with MHC molecules for presentation by cells, for example, antigen presenting cells, to specific T cells.

"Antigen presenting cells" (APC) are cells which present peptide fragments of protein antigens in association with MHC molecules on their cell surface. Some APCs may activate antigen specific T cells. Professional antigen-presenting cells are very efficient at internalizing antigen, either by phagocytosis or by receptor-mediated endocytosis, and then displaying a fragment of the antigen, bound to a class II MHC molecule, on their membrane. The T cell recognizes and interacts with the antigen-class II MHC molecule complex on the membrane of the antigen presenting cell. An additional co-stimulatory signal is then produced by the antigen presenting cell, leading to activation of the T cell. The expression of co-stimulatory molecules is a defining feature of professional antigen-presenting cells. The main types of professional antigen-presenting cells are dendritic cells, which have the broadest range of antigen presentation, and are probably the most important antigen presenting cells, macrophages, B-cells, and certain activated epithelial cells. Dendritic cells (DCs) are leukocyte populations that present antigens captured in peripheral tissues to T cells via both MHC class II and I antigen presentation pathways. It is well known that dendritic cells are potent inducers of immune responses and the activation of these cells is a critical step for the induction of antitumoral immunity. Dendritic cells are conveniently categorized as "immature" and "mature" cells, which can be used as a simple way to discriminate between two well characterized phenotypes. However, this nomenclature should not be construed to exclude all possible intermediate stages of differentiation. Immature dendritic cells are characterized as antigen presenting cells with a high capacity for antigen uptake and processing, which correlates with the high expression of Fc receptor (FcR) and mannose receptor. The mature phenotype is typically characterized by a lower expression of these markers, but a high expression of cell surface molecules responsible for T cell activation such as class I and class II MHC, adhesion molecules (e.g., CD54 and CD11) and costimulatory molecules (e.g., CD40, CD80, CD86 and 4-1 BB).

The terms "identical" and its grammatical equivalents as used herein or "sequence identity" in the context of two nucleic acid sequences or amino acid sequences of polypeptides refers to the residues in the two sequences which are the same when aligned for maximum correspondence over a specified comparison window. A "comparison window", as used herein, refers to a segment of at least about 20 contiguous positions, usually about 50 to about 200, more usually about 100 to about 150 in which a sequence may be compared to a reference sequence of the same number of contiguous positions after the two sequences are aligned optimally. Methods of alignment of sequences for comparison are well-known in the art. Optimal alignment of sequences for comparison may be conducted by the local homology algorithm of Smith and Waterman, Adv. Appl. Math., 2:482 (1981); by the alignment algorithm of Needleman and Wunsch, J. Mol. Biol., 48:443 (1970); by the search for similarity method of Pearson and Lipman, Proc. Nat. Acad. Sci. U.S.A., 85:2444 (1988); by computerized implementations of these algorithms (including, but not limited to CLUSTAL in the PC/Gene program by Intelligentics, Mountain View Calif., GAP, BESTFIT, BLAST, FASTA, and TFASTA in the Wisconsin Genetics Software Package, Genetics Computer Group (GCG), 575 Science Dr., Madison, Wis., U.S.A.); the CLUSTAL program is well described by Higgins and Sharp, Gene, 73:237-244 (1988) and Higgins and Sharp, CABIOS, 5:151-153 (1989); Corpet et al., Nucleic Acids Res., 16:10881-10890 (1988); Huang et al., Computer Applications in the Biosciences, 8:155-165 (1992); and Pearson et al., Methods in Molecular Biology, 24:307-331 (1994). Alignment is also often performed by inspection and manual alignment. In one class of embodiments, the polypeptides herein have at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a reference polypeptide, or a fragment thereof, e.g., as measured by BLASTP (or CLUSTAL, or any other available alignment software) using default parameters. Similarly, nucleic acids can also be described with reference to a starting nucleic acid, e.g., they can have 50%, 60%, 70%, 75%, 80%, 85%, 90%, 98%, 99% or 100% sequence identity to a reference nucleic acid or a fragment thereof, e.g., as measured by BLASTN (or CLUSTAL, or any other available alignment software) using default parameters. When one molecule is said to have certain percentage of sequence identity with a larger molecule, it means that when the two molecules are optimally aligned, said percentage of residues in the smaller molecule finds a match residue in the larger molecule in accordance with the order by which the two molecules are optimally aligned.

The term "substantially identical" and its grammatical equivalents as applied to nucleic acid or amino acid sequences mean that a nucleic acid or amino acid sequence comprises a sequence that has at least 90% sequence identity or more, at least 95%, at least 98% and at least 99%, compared to a reference sequence using the programs described above, e.g., BLAST, using standard parameters. For example, the BLASTN program (for nucleotide sequences) uses as defaults a word length (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix (see Henikoff & Henikoff, Proc. Natl. Acad. Sci. USA 89:10915 (1992)). Percentage of sequence identity is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. In embodiments, the substantial identity exists over a region of the sequences that is at least about 50 residues in length, over a region of at least about 100 residues, and in embodiments, the sequences are substantially identical over at least about 150 residues. In embodiments, the sequences are substantially identical over the entire length of the coding regions.

The term "vector" as used herein means a construct, which is capable of delivering, and usually expressing, one or more gene(s) or sequence(s) of interest in a host cell. Examples of vectors include, but are not limited to, viral vectors, naked DNA or RNA expression vectors, plasmid, cosmid, or phage vectors, DNA or RNA expression vectors associated with cationic condensing agents, and DNA or RNA expression vectors encapsulated in liposomes.

A polypeptide, antibody, polynucleotide, vector, cell, or composition which is "isolated" is a polypeptide, antibody, polynucleotide, vector, cell, or composition which is in a form not found in nature. Isolated polypeptides, antibodies, polynucleotides, vectors, cells, or compositions include those which have been purified to a degree that they are no longer in a form in which they are found in nature. In some embodiments, a polypeptide, antibody, polynucleotide, vector, cell, or composition which is isolated is substantially pure. In some embodiments, an "isolated polynucleotide" encompasses a PCR or quantitative PCR reaction comprising the polynucleotide amplified in the PCR or quantitative PCR reaction.

The term "isolated", "biologically pure" or their grammatical equivalents refers to material which is substantially or essentially free from components which normally accompany the material as it is found in its native state. Thus, isolated peptides described herein do not contain some or all of the materials normally associated with the peptides in their in situ environment. An "isolated" epitope refers to an epitope that does not include the whole sequence of the antigen from which the epitope was derived. Typically the "isolated" epitope does not have attached thereto additional amino acid residues that result in a sequence that has 100% identity over the entire length of a native sequence. The native sequence can be a sequence such as a tumor-associated antigen from which the epitope is derived. Thus, the term "isolated" means that the material is removed from its original environment (e.g., the natural environment if it is naturally occurring). An "isolated" nucleic acid is a nucleic acid removed from its natural environment. For example, a naturally-occurring polynucleotide or peptide present in a living animal is not isolated, but the same polynucleotide or peptide, separated from some or all of the coexisting materials in the natural system, is isolated. Such a polynucleotide could be part of a vector, and/or such a polynucleotide or peptide could be part of a composition, and still be "isolated" in that such vector or composition is not part of its natural environment. Isolated RNA molecules include in vivo or in vitro RNA transcripts of the DNA molecules described herein, and further include such molecules produced synthetically.

The term "substantially purified" and its grammatical equivalents as used herein refer to a nucleic acid sequence, polypeptide, protein or other compound which is essentially free, i.e., is more than about 50% free of, more than about 70% free of, more than about 90% free of, the polynucleotides, proteins, polypeptides and other molecules that the nucleic acid, polypeptide, protein or other compound is naturally associated with.

The term "substantially pure" as used herein refers to material which is at least 50% pure (i.e., free from contaminants), at least 90% pure, at least 95% pure, at least 98% pure, or at least 99% pure.

The terms "polynucleotide", "nucleotide", "nucleic acid", "polynucleic acid" or "oligonucleotide" and their grammatical equivalents are used interchangeably herein and refer to polymers of nucleotides of any length, and include DNA and RNA, for example, mRNA. Thus, these terms includes double and single stranded DNA, triplex DNA, as well as double and single stranded RNA. It also includes modified, for example, by methylation and/or by capping, and unmodified forms of the polynucleotide. The term is also meant to include molecules that include non-naturally occurring or synthetic nucleotides as well as nucleotide analogs. The nucleic acid sequences and vectors disclosed or contemplated herein may be introduced into a cell by, for example, transfection, transformation, or transduction. The nucleotides can be deoxyribonucleotides, ribonucleotides, modified nucleotides or bases, and/or their analogs, or any substrate that can be incorporated into a polymer by DNA or RNA polymerase. In some embodiments, the polynucleotide and nucleic acid can be in vitro transcribed mRNA. In some embodiments, the polynucleotide that is administered using the methods of the present disclosure is mRNA.

"Transfection," "transformation," or "transduction" as used herein refer to the introduction of one or more exogenous polynucleotides into a host cell by using physical or chemical methods. Many transfection techniques are known in the art and include, for example, calcium phosphate DNA co-precipitation (see, e.g., Murray E. J. (ed.), Methods in Molecular Biology, Vol. 7, Gene Transfer and Expression Protocols, Humana Press (1991)); DEAE-dextran; electroporation; cationic liposome-mediated transfection; tungsten particle-facilitated microparticle bombardment (Johnston, Nature, 346: 776-777 (1990)); and strontium phosphate DNA co-precipitation (Brash et al., Mol. Cell Biol., 7: 2031-2034 (1987)). Phage or viral vectors can be introduced into host cells, after growth of infectious particles in suitable packaging cells, many of which are commercially available.

Nucleic acids and/or nucleic acid sequences are "homologous" when they are derived, naturally or artificially, from a common ancestral nucleic acid or nucleic acid sequence. Proteins and/or protein sequences are "homologous" when their encoding DNAs are derived, naturally or artificially, from a common ancestral nucleic acid or nucleic acid sequence. The homologous molecules can be termed homologs. For example, any naturally occurring proteins, as described herein, can be modified by any available mutagenesis method. When expressed, this mutagenized nucleic acid encodes a polypeptide that is homologous to the protein encoded by the original nucleic acid. Homology is generally inferred from sequence identity between two or more nucleic acids or proteins (or sequences thereof). The precise percentage of identity between sequences that is useful in establishing homology varies with the nucleic acid and protein at issue, but as little as 25% sequence identity is routinely used to establish homology. Higher levels of sequence identity, e.g., 30%, 40%, 50%, 60%, 70%, 80%, 90%, 95% or 99% or more can also be used to establish homology. Methods for determining sequence identity percentages (e.g., BLASTP and BLASTN using default parameters) are described herein and are generally available.

The term "subject" refers to any animal (e.g., a mammal), including, but not limited to, humans, non-human primates, canines, felines, rodents, and the like, which is to be the recipient of a particular treatment. Typically, the terms "subject" and "patient" are used interchangeably herein in reference to a human subject.

The terms "effective amount" or "therapeutically effective amount" or "therapeutic effect" refer to an amount of a therapeutic effective to "treat" a disease or disorder in a subject or mammal. The therapeutically effective amount of a drug has a therapeutic effect and as such can prevent the development of a disease or disorder; slow down the development of a disease or disorder; slow down the progression of a disease or disorder; relieve to some extent one or more of the symptoms associated with a disease or disorder; reduce morbidity and mortality; improve quality of life; or a combination of such effects.

The terms "treating" or "treatment" or "to treat" or "alleviating" or "to alleviate" refer to both (1) therapeutic measures that cure, slow down, lessen symptoms of, and/or halt progression of a diagnosed pathologic condition or disorder; and (2) prophylactic or preventative measures that prevent or slow the development of a targeted pathologic condition or disorder. Thus those in need of treatment include those already with the disorder; those prone to have the disorder; and those in whom the disorder is to be prevented.

"Pharmaceutically acceptable" refers to a generally non-toxic, inert, and/or physiologically compatible composition or component of a composition.

A "pharmaceutical excipient" or "excipient" comprises a material such as an adjuvant, a carrier, pH-adjusting and buffering agents, tonicity adjusting agents, wetting agents, preservatives, and the like. A "pharmaceutical excipient" is an excipient which is pharmaceutically acceptable.

II. Neoantigens and Uses Thereof

One of the critical barriers to developing curative and tumor-specific immunotherapy is the identification and selection of highly specific and restricted tumor antigens to avoid autoimmunity. Tumor neoantigens, which arise as a result of genetic change (e.g., inversions, translocations, deletions, missense mutations, splice site mutations, etc.) within malignant cells, represent the most tumor-specific class of antigens. Neoantigens have rarely been used in cancer vaccine or immunogenic compositions due to technical difficulties in identifying them, selecting optimized antigens, and producing neoantigens for use in a vaccine or immunogenic composition. These problems may be addressed by: identifying mutations in neoplasias/tumors which are present at the DNA level in tumor but not in matched germline samples from a high proportion of subjects having cancer; analyzing the identified mutations with one or more peptide-MHC binding prediction algorithms to generate a plurality of neoantigen T cell epitopes that are expressed within the neoplasia/tumor and that bind to a high proportion of patient HLA alleles; and synthesizing the plurality of neoantigenic peptides selected from the sets of all neoantigen peptides and predicted binding peptides for use in a cancer vaccine or immunogenic composition suitable for treating a high proportion of subjects having cancer.

For example, translating peptide sequencing information into a therapeutic vaccine may include prediction of mutated peptides that can bind to HLA molecules of a high proportion of individuals. Efficiently choosing which particular mutations to utilize as immunogen requires the ability to predict which mutated peptides would efficiently bind to a high proportion of patient's HLA alleles. Recently, neural network based learning approaches with validated binding and non-binding peptides have advanced the accuracy of prediction algorithms for the major HLA-A and —B alleles. However, even using advanced neural network-based algorithms to encode HLA-peptide binding rules, several factors limit the power to predict peptides presented on HLA alleles.

Another example of translating peptide sequencing information into a therapeutic vaccine may include formulating the drug as a multi-epitope vaccine of long peptides. Targeting as many mutated epitopes as practically possible takes advantage of the enormous capacity of the immune system, prevents the opportunity for immunological escape by down-modulation of an immune targeted gene product, and compensates for the known inaccuracy of epitope prediction approaches. Synthetic peptides provide a useful means to prepare multiple immunogens efficiently and to rapidly translate identification of mutant epitopes to an effective vaccine. Peptides can be readily synthesized chemically and easily purified utilizing reagents free of contaminating bacteria or animal substances. The small size allows a clear focus on the mutated region of the protein and also reduces irrelevant antigenic competition from other components (non-mutated protein or viral vector antigens).

Yet another example of translating peptide sequencing information into a therapeutic vaccine may include a combination with a strong vaccine adjuvant. Effective vaccines may require a strong adjuvant to initiate an immune response. For example, poly-ICLC, an agonist of TLR3 and the RNA helicase-domains of MDA5 and RIG3, has shown several desirable properties for a vaccine adjuvant. These properties include the induction of local and systemic activation of immune cells in vivo, production of stimulatory chemokines and cytokines, and stimulation of antigen-presentation by DCs. Furthermore, poly-ICLC can induce durable $CD4^+$ and $CD8^+$ responses in humans. Importantly, striking similarities in the upregulation of transcriptional and signal transduction pathways were seen in subjects vaccinated with poly-ICLC and in volunteers who had received the highly effective, replication-competent yellow fever vaccine. Furthermore, >90% of ovarian carcinoma patients immunized with poly-ICLC in combination with a NYESO-1 peptide vaccine (in addition to Montanide) showed induction of CD4$^+$ and CD8$^+$ T cell, as well as antibody responses to the peptide in a recent phase 1 study. At the same time, poly-ICLC has been extensively tested in more than 25 clinical trials to date and exhibited a relatively benign toxicity profile.

In some aspects, provided herein is a composition comprising: a first peptide comprising a first neoepitope of a protein and a second peptide comprising a second neoepitope of the same protein, a polynucleotide encoding the first peptide and the second peptide, one or more APCs comprising the first peptide and the second peptide, or a first T cell receptor (TCR) specific for the first neoepitope in complex with an HLA protein and a second TCR specific for the second neoepitope in complex with an HLA protein; wherein the first peptide is different from the second peptide, and wherein the first neoepitope comprises a mutation and the second neoepitope comprises the same mutation.

In some aspects, provided herein is a composition comprising: a first peptide comprising a first neoepitope of a region of a protein and a second peptide comprising a second neoepitope of the region of the same protein, wherein the first neoepitope and the second neoepitope comprise at least one amino acid of the region that is the same, a polynucleotide encoding the first peptide and the second peptide, on or more APCs comprising the first peptide and the second peptide, or a first T cell receptor (TCR) specific for the first neoepitope in complex with an HLA protein and a second TCR specific for the second neoepitope in complex with an HLA protein; wherein the first peptide is different from the second peptide, and wherein the first neoepitope comprises a first mutation and the second neoepitope comprises a second mutation.

In some embodiments, the first mutation and the second mutation are the same. In some embodiments, the first peptide and the second peptide are different molecules. In some embodiments, the first neoepitope comprises a first neoepitope of a region of the same protein, wherein the second neoepitope comprises a second neoepitope of the region of the same protein. In some embodiments, the first neoepitope and the second neoepitope comprise at least one amino acid of the region that is the same. In some embodiments, the region of the protein comprises at least 9, 10, 11, 12, 13, 14, 15, 16, 17, 18, 19, 20, 21, 22, 23, 24, 25, 26, 27, 28, 29, 30, 40, 50, 60, 70, 80, 90, 100, 150, 200, 250, 300, 350, 400, 450, 500, 600, 700, 800, 900, or 1,000 contiguous amino acids of the protein. In some embodiments, the region of the protein comprises at most 10, 11, 12, 13, 14, 15, 16, 17, 18, 19, 20, 21, 22, 23, 24, 25, 26, 27, 28, 29, 30, 40, 50, 60, 70, 80, 90, 100, 150, 200, 250, 300, 350, 400, 450, 500, 600, 700, 800, 900, or 1,000 contiguous amino acids of the protein. In some embodiments, the first neoepitope binds to a class I HLA protein to form a class I HLA-peptide complex. In some embodiments, the second neoepitope binds to a class II HLA protein to form a class II HLA-peptide complex. In some embodiments, the second neoepitope binds to a class I HLA protein to form a class I HLA-peptide complex. In some embodiments, the first neoepitope binds to a class II HLA protein to form a class II HLA-peptide complex. In some embodiments, the first neoepitope is a first neoepitope peptide processed from the first peptide and/or the second neoepitope is a second neoepitope peptide processed from the second peptide. In some embodiments, the first neoepitope is shorter in length than first peptide and/or the second neoepitope is shorter in length than second peptide. In some embodiments, the first neoepitope peptide is processed by an antigen presenting cell (APC) comprising the first peptide and/or the second neoepitope peptide is processed by an APC comprising the second peptide. In some embodiments, the first neoepitope activates CD8$^+$ T cells. In some embodiments, the second neoepitope activates CD4$^+$ T cells. In some embodiments, the second neoepitope activates CD8$^+$ T cells. In some embodiments, the first neoepitope activates CD4$^+$ T cells. In some embodiments, a TCR of a CD4 T cell binds to a class II HLA-peptide complex comprising the first or second peptide. In some embodiments, a TCR of a CD8$^+$ T cell binds to a class I HLA-peptide complex comprising the first or second peptide. In some embodiments, a TCR of a CD4 T cell binds to a class I HLA-peptide complex comprising the first or second peptide. In some embodiments, a TCR of a CD8$^+$ T cell binds to a class II HLA-peptide complex comprising the first or second peptide. In some embodiments, the one or more APCs comprise a first APC comprising the first peptide and a second APC comprising the second peptide. In some embodiments, the mutation is selected from the group consisting of a point mutation, a splice-site mutation, a frameshift mutation, a read-through mutation, a gene fusion mutation and any combination thereof. In some embodiments, the first neoepitope and the second neoepitope comprises a sequence encoded by a gene of Table 1 or 2. In some embodiments, the protein is encoded by a gene of Table 1 or 2. In some embodiments, the mutation is a mutation of column 2 of Table 1 or 2. In some embodiments, the mutation is a mutation of column 1 of Tables 3 to 14. In some embodiments, the protein is KRAS. In some embodiments, a single polypeptide comprises the first peptide and the second peptide, or a single polynucleotide encodes the first peptide and the second peptide. In some embodiments, the first peptide and the second peptide are encoded by a sequence transcribed from a same transcription start site. In some embodiments, the first peptide is encoded by a sequence transcribed from a first transcription start site and the second peptide is encoded by a sequence transcribed from a second transcription start site. In some embodiments, the single polypeptide has a length of at least 18; 19; 20; 21; 22; 23; 24; 25; 26; 27; 28; 29; 30; 40; 50; 60; 70; 80; 90; 100; 150; 200; 250; 300; 350; 400; 450; 500; 600; 700; 800; 900; 1,000; 1,500; 2,000; 2,500; 3,000; 4,000; 5,000; 7,500; or 10,000 amino acids. In some embodiments, the polypeptide comprises a first sequence with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%, sequence identity to a first corresponding wild-type sequence; and a second sequence with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%, sequence identity to a corresponding second wild-type sequence. In some embodiments, the polypeptide comprises a first sequence of at least 8 or 9 contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%, sequence identity to a corresponding first wild-type sequence; and a second sequence of at least 16 or 17 contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%, sequence identity to a corresponding second wild-type sequence. In some embodiments, the second peptide is longer than the first peptide In some embodiments, the first peptide is longer than the second peptide. In some embodiments, the first peptide has a length of at least 9; 10; 11; 12; 13; 14; 15; 16; 17; 18; 19; 20; 21; 22; 23; 24; 25; 26; 27; 28; 29; 30; 40; 50; 60; 70; 80; 90; 100; 150; 200; 250; 300; 350; 400; 450; 500; 600; 700; 800; 900; 1,000; 1,500; 2,000; 2,500; 3,000; 4,000; 5,000; 7,500; or 10,000 amino acids. In some embodiments, the second peptide has a length of at least 17; 18; 19; 20; 21; 22; 23; 24; 25; 26; 27; 28; 29; 30; 40; 50; 60; 70; 80; 90; 100; 150; 200; 250; 300; 350; 400; 450; 500; 600; 700; 800; 900; 1,000; 1,500; 2,000; 2,500; 3,000; 4,000; 5,000; 7,500; or 10,000 amino acids. In some embodiments, the first peptide comprises a sequence of at least 9 contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity to a corresponding wild-type sequence. In some embodiments, the second peptide comprises a sequence of at least 17 contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity to a corresponding wild-type sequence. In some embodiments, the second neoepitope is longer than the first neoepitope. In some embodiments, the first neoepitope has a length of at least 8 amino acids. In some embodiments, the first neoepitope has a length of from 8 to 12 amino acids. In some embodiments, the first neoepitope comprises a sequence of at least 8 contiguous amino acids, wherein at least 2 of the 8 contiguous amino acids are different at corresponding positions of a wild-type sequence. In some embodiments, the second neoepitope has a length of at least 16 amino acids. In some embodiments, the second neoepitope has a length of from 16 to 25 amino acids. In some embodiments, the second neoepitope comprises a sequence of at least 16 contiguous amino acids, wherein at least 2 of the 16 contiguous amino acids are different at corresponding positions of a wild-type sequence.

In some embodiments, the first peptide comprises at least one an additional mutation. In some embodiments, one or more of the at least one additional mutation is not a mutation in the first neoepitope. In some embodiments, one or more of the at least one additional mutation is a mutation in the first neoepitope. In some embodiments, the second peptide comprises at least one additional mutation. In some embodiments, one or more of the at least one additional mutation is not a mutation in the second neoepitope. In some embodiments, one or more of the at least one additional mutation is a mutation in the second neoepitope. In some embodiments, the first peptide, the second peptide or both comprise at least one flanking sequence, wherein the at least one flanking sequence is upstream or downstream of the neoepitope. In some embodiments, the at least one flanking sequence has at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to a corresponding wild-type sequence. In some embodiments, the at least one flanking sequence comprises a non-wild-type sequence. In some embodiments, the at least one flanking sequence is a N-terminus flanking sequence. In some embodiments, the at least one flanking sequence is a C-terminus flanking sequence. In some embodiments, the at least one flanking sequence of the first peptide has at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to the at least one flanking sequence of the second peptide. In some embodiments, the at least one flanking region of the first peptide is different from the at least one flanking region of the second peptide. In some embodiments, the at least one flanking residue comprises the mutation. In some embodiments, the first neoepitope, the second neoepitope or both comprises at least one anchor residue. In some embodiments, the at least one anchor residue of the first neoepitope is at a canonical anchor position. In some embodiments, the at least one anchor residue of the first neoepitope is at a non-canonical anchor position. In some embodiments, the at least one anchor residue of the second neoepitope is at a canonical anchor position. In some embodiments, the at least one anchor residue of the second neoepitope is at a non-canonical anchor position. In some embodiments, the at least one anchor residue of the first neoepitope is different from the at least one anchor residue of the second neoepitope. In some embodiments, the at least one anchor residue is a wild-type residue. In some embodiments, the at least one anchor residue is a substitution. In some embodiments, the first neoepitope and/or the second neoepitope binds to an HLA protein with a greater affinity than a corresponding neoepitope without the substitution. In some embodiments, the first neoepitope and/or the second neoepitope binds to an HLA protein with a greater affinity than a corresponding wild-type sequence without the substitution. In some embodiments, at least one anchor residue does not comprise the mutation. In some embodiments, the first neoepitope, the second neoepitope or both comprise at least one anchor residue flanking region. In some embodiments, the neoepitope comprises at least one anchor residue. In some embodiments, the at least one anchor residues comprises at least two anchor residues. In some embodiments, the at least two anchor residues are separated by a separation region comprising at least 1 amino acid. In some embodiments, the at least one anchor residue flanking region is not within the separation region. In some embodiments, the at least one anchor residue flanking region is upstream of a N-terminal anchor residue of the at least two anchor residues downstream of a C-terminal anchor residue of the at least two anchor residue both (a) and (b).

In some embodiments, composition comprises an adjuvant. In some embodiments, the composition comprises one or more additional peptides, wherein the one or more additional peptides comprise a third neoepitope. In some embodiments, the first and/or second neoepitope binds to an HLA protein with a greater affinity than a corresponding wild-type sequence. In some embodiments, the first and/or second neoepitope binds to an HLA protein with a $K_D$ or an $IC_{50}$ less than 1000 nM, 900 nM, 800 nM, 700 nM, 600 nM, 500 nM, 250 nM, 150 nM, 100 nM, 50 nM, 25 nM or 10 nM. In some embodiments, the first and/or second neoepitope binds to an HLA class I protein with a $K_D$ or an $IC_{50}$ less than 1000 nM, 900 nM, 800 nM, 700 nM, 600 nM, 500 nM, 250 nM, 150 nM, 100 nM, 50 nM, 25 nM or 10 nM. In some embodiments, the first and/or second neoepitope binds to an HLA class II protein with a $K_D$ or an $IC_{50}$ less than 1000 nM, 900 nM, 800 nM, 700 nM, 600 nM, 500 nM, 250 nM, 150 nM, 100 nM, 50 nM, 25 nM or 10 nM. In some embodiments, the first and/or second neoepitope binds to a protein encoded by an HLA allele expressed by a subject. In some embodiments, the mutation is not present in non-cancer cells of a subject. In some embodiments, the first and/or second neoepitope is encoded by a gene or an expressed gene of a subject's cancer cells. In some embodiments, the composition comprises a first T cell comprising the first TCR. In some embodiments, the composition comprises a second T cell comprising the second TCR. In some embodiments, the first TCR comprises a non-native intracellular domain and/or the second TCR comprises a non-native intracellular domain. In some embodiments, the first TCR is a soluble TCR and/or the second TCR is a soluble TCR. In some embodiments, the first and/or second T cell is a cytotoxic T cell. In some embodiments, the first and/or second T cell is a gamma delta T cell. In some embodiments, the first and/or second T cell is a helper T cell. In some embodiments, the first T cell is a T cell stimulated, expanded or induced with the first neoepitope and/or the second T cell is a T cell stimulated, expanded or induced with the second neoepitope. In some embodiments, the first and/or second T cell is an autologous T cell. In some embodiments, the first and/or second T cell is an allogenic T cell. In some embodiments, the first and/or second T cell is an engineered T cell. In some embodiments, the first and/or second T cell is a T cell of a cell line. In some embodiments, the first and/or second TCR binds to an HLA-peptide complex with a $K_D$ or an $IC_{50}$ of less than 1000 nM, 900 nM, 800 nM, 700 nM, 600 nM, 500 nM, 250 nM, 150 nM, 100 nM, 50 nM, 25 nM or 10 nM. In some aspects, provided herein is a vector comprising a polynucleotide encoding a first and a second peptide described herein. In some embodiments, the polynucleotide is operably linked to a promoter. In some embodiments, the vector is a self-amplifying RNA replicon, plasmid, phage, transposon, cosmid, virus, or virion. In some embodiments, the vector is a viral vector. In some embodiments, the vector is derived from a retrovirus, lentivirus, adenovirus, adeno-associated virus, herpes virus, pox virus, alpha virus, vaccina virus, hepatitis B virus, human papillomavirus or a pseudotype thereof. In some embodiments, the vector is a non-viral vector. In some embodiments, the non-viral vector is a nanoparticle, a cationic lipid, a cationic polymer, a metallic nanopolymer, a nanorod, a liposome, a micelle, a microbubble, a cell-penetrating peptide, or a liposphere.

In some aspects, provided herein is a pharmaceutical composition comprising: a composition described herein, or a vector described herein; and a pharmaceutically acceptable excipient.

In some embodiments, the plurality of cells is autologous cells. In some embodiments, the plurality of APC cells is autologous cells. In some embodiments, the plurality of T cells is autologous cells. In some embodiments, the pharmaceutical composition further comprises an immunomodulatory agent or an adjuvant. In some embodiments, the immunomodulatory agent is a cytokine. In some embodiments, the adjuvant is Hiltonol.

In some aspects, provided herein is a method of treating cancer, the method comprising administering to a subject in need thereof a pharmaceutical composition described herein.

In some aspects, provided herein is a method of preventing resistance to a cancer therapy, the method comprising administering to a subject in need thereof a pharmaceutical composition described herein.

In some aspects, provided herein is a method of inducing an immune response, the method comprising administering to a subject in need thereof a pharmaceutical composition described herein.

In some embodiments, the immune response is a humoral response. In some embodiments, the first peptide and the second peptide are administered simultaneously, separately or sequentially. In some embodiments, the first peptide is sequentially administered after the second peptide. In some embodiments, the second peptide is sequentially administered after the first peptide. In some embodiments, the first peptide is sequentially administered after a time period sufficient for the second peptide to activate the T cells. In some embodiments, the second peptide is sequentially administered after a time period sufficient for the first peptide to activate the T cells. In some embodiments, the first peptide is sequentially administered after the second peptide to restimulate the T cells. In some embodiments, the second peptide is sequentially administered after the first peptide to restimulate the T cells. In some embodiments, the first peptide is administered to stimulate the T cells and the second peptide is administered after the first peptide to restimulate the T cells. In some embodiments, the second peptide is administered to stimulate the T cells and the first peptide is administered after the second peptide to restimulate the T cells. In some embodiments, the subject has cancer, wherein the cancer is selected from the group consisting of melanoma, ovarian cancer, lung cancer, prostate cancer, breast cancer, colorectal cancer, endometrial cancer, and chronic lymphocytic leukemia (CLL). In some embodiments, the subject has a breast cancer that is resistant to anti-estrogen therapy. In some embodiments, the breast cancer expresses an estrogen receptor with a mutation. In some embodiments, the subject has a CLL that is resistant to ibrutinib therapy. In some embodiments, the CLL expresses a Bruton tyrosine kinase with a mutation, such as a C481S mutation. In some embodiments, the subject has a lung cancer that is resistant to a tyrosine kinase inhibitor. In some embodiments, the lung cancer expresses an epidermal growth factor receptor (EGFR) with a mutation, such as a T790M, L792F, or C797S mutation. In some embodiments, the plurality of APC cells comprising the first peptide and the plurality of APC cells comprising the second peptide are administered simultaneously, separately or sequentially. In some embodiments, the plurality of T cells comprising the first TCR and the plurality of T cells comprising the second TCR are administered simultaneously, separately or sequentially. In some embodiments, the method further comprises administering at least one additional therapeutic agent or modality. In some embodiments, the at least one additional therapeutic agent or modality is surgery, a checkpoint inhibitor, an antibody or fragment thereof, a chemotherapeutic agent, radiation, a vaccine, a small molecule, a T cell, a vector, and APC, a polynucleotide, an oncolytic virus or any combination thereof. In some embodiments, the at least one additional therapeutic agent is an anti-PD-1 agent and anti-PD-L1 agent, an anti-CTLA-4 agent, or an anti-CD40 agent. In some embodiments, the additional therapeutic agent is administered before, simultaneously, or after administering a pharmaceutical composition according described herein.

III. Peptides

In aspects, the present disclosure provides isolated peptides that comprise a tumor specific mutation from Table 1 to 14. These peptides and polypeptides are referred to herein as "neoantigenic peptides" or "neoantigenic polypeptides". The polypeptides or peptides can be a variety of lengths, either in their neutral (uncharged) forms or in forms which are salts, and either free of modifications such as glycosylation, side chain oxidation, or phosphorylation or containing these modifications, subject to the condition that the modification not destroy the biological activity of the polypeptides as herein described.

TABLE 1

| Gene | Exemplary Protein Change | Mutation Sequence Context | Peptides (HLA allele example(s)) | Exemplary Diseases |
|---|---|---|---|---|
| | TABLE 1A | POINT MUTATION [1] | | |
| ABL1 | E255K | VADGLITTLHYPAPKR NKPTVYGVSPNYDKW EMERTDITMKHKLGG GQYGKVYEGVWKKY SLTVAVKTLKEDTME VEEFLKEAAVMKEIK HPNLVQLLGVC (SEQ ID NO: 238) | GQYGKVYEG (A02.01) (SEQ ID NO: 377) GQYGKVYEGV (A02.01) (SEQ ID NO: 378) KLGGGQYGK (A03.01) (SEQ ID NO: 379) KLGGGQYGKV (A02.01) (SEQ ID NO: 380) KVYEGVWKK (A02.01, A03.01) (SEQ ID NO: 381) KVYEGVWKKY (A03.01) (SEQ ID NO: 382) QYGKVYEGV (A24.02) (SEQ ID NO: 383) QYGKVYEGVW (A24.02) (SEQ ID NO: 384) | Chronic myeloid leukemia (CML), Acute lymphocytic leukemia (ALL), Gastrointestinal stromal tumors (GIST) |
| ABL1 | E255V | VADGLITTLHYPAPKR NKPTVYGVSPNYDKW EMERTDITMKHKLGG GQYGVVYEGVWKKY SLTVAVKTLKEDTME VEEFLKEAAVMKEIK HPNLVQLLGVC (SEQ ID NO: 239) | GQYGVVYEG (A02.01) (SEQ ID NO: 385) GQYGVVYEGV (A02.01) (SEQ ID NO: 386) KLGGGQYGV (A02.01) (SEQ ID NO: 387) KLGGGQYGVV (A02.01) (SEQ ID NO: 388) QYGVVYEGV (A24.02) (SEQ ID NO: 389) QYGVVYEGVW (A24.02) (SEQ ID NO: 390) VVYEGVWKK (A02.01, A03.01) (SEQ ID NO: 391) VVYEGVWKKY (A03.01) (SEQ ID NO: 392) | Chronic myeloid leukemia (CML), Acute lymphocytic leukemia (ALL), Gastrointestinal stromal tumors (GIST) |
| ABL1 | M351T | LLGVCTREPPFYIITEF MTYGNLLDYLRECNR QEVNAVVLLYMATQI SSATEYLEKKNFIHRD LAARNCLVGENHLVK VADFGLSRLMTGDTY TAHAGAKF (SEQ ID NO: 240) | ATQISSATEY (A01.01) (SEQ ID NO: 393) ISSATEYLEK (A03.01) (SEQ ID NO: 394) SSATEYLEK (A03.01) (SEQ ID NO: 395) TQISSATEYL (A02.01) (SEQ ID NO: 396) YMATQISSAT (A02.01) (SEQ ID NO: 397) | Chronic myeloid leukemia (CML), Acute lymphocytic leukemia (ALL), Gastrointestinal stromal tumors (GIST) |
| ABL1 | T315I | SLTVAVKTLKEDTME VEEFLKEAAVMKEIK HPNLVQLLGVCTREPP FYIIEFMTYGNLLDYL RECNRQEVNAVVLLY MATQISSAMEYLEKK NFIHRDLA (SEQ ID NO: 241) | FYIIIEFMTY (A24.02) (SEQ ID NO: 398) IIEFMTYGNL (A02.01) (SEQ ID NO: 399) IIIEFMTYG (A02.01) (SEQ ID NO: 400) IIIEFMTYGN (A02.01) (SEQ ID NO: 401) YIIIEFMTYG (A02.01) (SEQ ID NO: 402) | Chronic myeloid leukemia (CML), Acute lymphocytic leukemia (ALL), Gastrointestinal stromal tumors (GIST) |
| ABL1 | Y253H | STVADGLITTLHYPAP KRNKPTVYGVSPNYD KWEMERTDITMKHKL GGGQHGEVYEGVWK KYSLTVAVKTLKEDT MEVEEFLKEAAVMKE IKHPNLVQLLG (SEQ ID NO: 242) | GQHGEVYEGV (A02.01) (SEQ ID NO: 403) KLGGGQHGEV (A02.01) (SEQ ID NO: 404) | Chronic myeloid leukemia (CML), Acute lymphocytic leukemia (ALL), Gastrointestinal stromal tumors (GIST) |
| ALK | G1269A | SSLAMLDLLHVARDI ACGCQYLEENHFIHR DIAARNCLLTCPGPGR VAKIADFGMARDIYR ASYYRKGGCAMLPVK WMPPEAFMEGIFTSKT DTWSFGVLL (SEQ ID NO: 243) | KIADFGMAR (A03.01) (SEQ ID NO: 405) RVAKIADFGM (A02.01, B07.02) (SEQ ID NO: 406) | NSCLC |

TABLE 1-continued

| | | | | |
|---|---|---|---|---|
| ALK | L1196M | QVAVKTLPEVCSEQD ELDFLMEALIISKFNH QNIVRCIGVSLQSLPRF ILMELMAGGDLKSFL RETRPRPSQPSSLAML DLLHVARDIACGCQY LEENHFI (SEQ ID NO: 244) | FILMELMAGG (A02.01) (SEQ ID NO: 407) ILMELMAGG (A02.01) (SEQ ID NO: 408) ILMELMAGGD (A02.01) (SEQ ID NO: 409) LMELMAGGDL (A02.01) (SEQ ID NO: 410) LPRFILMEL (B07.02, B08.01) (SEQ ID NO: 411) LPRFILMELM (B07.02) (SEQ ID NO: 412) LQSLPRFILM (A02.01, B08.01) (SEQ ID NO: 413) SLPRFILMEL (A02.01, A24.02, B07.02, B08.01) (SEQ ID NO: 414) | NSCLC |
| BRAF | V600E | MIKLIDIARQTAQGMD YLHAKSIIHRDLKSNN IFLHEDLTVKIGDFGL ATEKSRWSGSHQFEQ LSGSILWMAPEVIRMQ DKNPYSFQSDVYAFGI VLYELM (SEQ ID NO: 245) | LATEKSRWS (A02.01, B08.01) (SEQ ID NO: 415) LATEKSRWSG (A02.01, B08.01) (SEQ ID NO: 416) | CRC, GBM, KIRP, LUAD, SKCM, THCA |
| BTK | C481S | MIKEGSMSEDEFIEEA KVMMNLSHEKLVQL YGVCTKQRPIFIITEY MANGSLLNYLREMRH RFQTQQLLEMCKDVC EAMEYLESKQFLHRD LAARNCLVND (SEQ ID NO: 246) | EYMANGSLL (A24.02) (SEQ ID NO: 417) MANGSLLNY (A01.01, A03.01, A11.01) (SEQ ID NO: 418) MANGSLLNYL (A02.01, B07.02, B08.01) (SEQ ID NO: 419) SLLNYLREM (A02.01, B07.02, B08.01) (SEQ ID NO: 420) YMANGSLLN (A02.01) (SEQ ID NO: 421) YMANGSLLNY (A01.01, A03.01, A11.01) (SEQ ID NO: 422) | CLL |
| EEF1B2 | S43G | MGFGDLKSPAGLQVL NDYLADKSYIEGYVPS QADVAVFEAVSGPPP ADLCHALRWYNHIKS YEKEKASLPGVKKAL GKYGPADVEDTTGSG AT (SEQ ID NO: 247) | GPPPADLCHAL (B07.02) (SEQ ID NO: 423) | BLCA, KIRP, PRAD, SKCM |
| EGFR | S492R | SLNITSLGLRSLKEISD GDVIISGNKNLCYANT INWKKLFGTSGQKTKI IRNRGENSCKATGQV CHALCSPEGCWGPEP RDCVSCRNVSRGREC VDKCNLL (SEQ ID NO: 248) | IIRNRGENSCK (A03.01) (SEQ ID NO: 424) | CRC |
| EGFR | T790M | IPVAIKELREATSPKA NKEILDEAYVMASVD NPHVCRLLGICLTSTV QLIMQLMPFGCLLDY VREHKDNIGSQYLLN WCVQIAKGMNYLED RRL VHRDLAA (SEQ ID NO: 249) | CLTSTVQLIM (A01.01, A02.01) (SEQ ID NO: 425) IMQLMPFGC (A02.01) (SEQ ID NO: 426) IMQLMPFGCL (A02.01, A24.02, B08.01) (SEQ ID NO: 427) LIMQLMPFG (A02.01) (SEQ ID NO: 428) LIMQLMPFGC (A02.01) (SEQ ID NO: 429) LTSTVQLIM (A01.01) (SEQ ID NO: 430) MQLMPFGCL (A02.01, B07.02, B08.01) (SEQ ID NO: 431) MQLMPFGCLL (A02.01, A24.02, B08.01) (SEQ ID NO: 432) | NSCLC, PRAD |

TABLE 1-continued

| | | | QLIMQLMPF (A02.01, A24.02, B08.01) (SEQ ID NO: 433)<br>QLIMQLMPFG (A02.01) (SEQ ID NO: 434)<br>STVQLIMQL (A02.01) (SEQ ID NO: 435)<br>VQLIMQLMPF (A02.01, A24.02, B08.01) (SEQ ID NO: 436) | |
|---|---|---|---|---|
| ERBB3 | V104M | ERCEVVMGNLEIVLT GHNADLSFLQWIREV TGYVLVAMNEFSTLP LPNLRMVRGTQVYDG KFAIFVMLNYNTNSSH ALRQLRLTQLTEILSG GVYIEKNDK (SEQ ID NO: 250) | | CRC, Stomach Cancer |
| ESR1 | D538G | HLMAKAGLTLQQQH QRLAQLLLILSHIRHM SNKGMEHLYSMKCK NVVPLYGLLLEMLDA HRLHAPTSRGGASVE ETDQSHLATAGSTSSH SLQKYYITGEA (SEQ ID NO: 251) | GLLLEMLDA (A02.01) (SEQ ID NO: 437)<br>LYGLLLEML (A24.02) (SEQ ID NO: 438)<br>NVVPLYGLL (A02.01) (SEQ ID NO: 439)<br>PLYGLLLEM (A02.01) (SEQ ID NO: 440)<br>PLYGLLLEML (A02.01, A24.02) (SEQ ID NO: 441)<br>VPLYGLLLEM (B07.02) (SEQ ID NO: 442)<br>VVPLYGLLL (A02.01, A24.02) (SEQ ID NO: 443) | Breast Cancer |
| ESR1 | S463P | NQGKCVEGMVEIFDM LLATSSRFRMMNLQG EEFVCLKSIILLNSGVY TFLPSTLKSLEEKDHIH RVLDKITDTLIHLMAK AGLTLQQQHQRLAQL LLILSH (SEQ ID NO: 252) | FLPSTLKSL (A02.01, A24.02, B08.01) (SEQ ID NO: 444)<br>GVYTFLPST (A02.01) (SEQ ID NO: 445)<br>GVYTFLPSTL (A02.01, A24.02) (SEQ ID NO: 446)<br>TFLPSTLKSL (A24.02) (SEQ ID NO: 447)<br>VYTFLPSTL (A24.02) (SEQ ID NO: 448)<br>YTFLPSTLK (A03.01) (SEQ ID NO: 449) | Breast Cancer |
| ESR1 | Y537C | IHLMAKAGLTLQQQH QRLAQLLLILSHIRHM SNKGMEHLYSMKCK NVVPLCDLLLEMLDA HRLHAPTSRGGASVE ETDQSHLATAGSTSSH SLQKYYITGE (SEQ ID NO: 253) | NVVPLCDLL (A02.01) (SEQ ID NO: 450)<br>NVVPLCDLLL (SEQ ID NO: 451)<br>PLCDLLLEM (A02.01) (SEQ ID NO: 452)<br>PLCDLLLEML (A02.01) (SEQ ID NO: 453)<br>VPLCDLLLEM (B07.02) (SEQ ID NO: 454)<br>VVPLCDLLL (A02.01, A24.02) (SEQ ID NO: 455) | Breast Cancer |
| ESR1 | Y537N | IHLMAKAGLTLQQQH QRLAQLLLILSHIRHM SNKGMEHLYSMKCK NVVPLNDLLLEMLDA HRLHAPTSRGGASVE ETDQSHLATAGSTSSH SLQKYYITGE (SEQ ID NO: 254) | NVVPLNDLL (A02.01) (SEQ ID NO: 456)<br>NVVPLNDLLL (A02.01) (SEQ ID NO: 457)<br>PLNDLLLEM (A02.01) (SEQ ID NO: 458)<br>PLNDLLLEML (A02.01) (SEQ ID NO: 459)<br>VPLNDLLLEM (B07.02) (SEQ ID NO: 460) | Breast Cancer |

TABLE 1-continued

| | | | | |
|---|---|---|---|---|
| ESR1 | Y537S | IHLMAKAGLTLQQQH QRLAQLLLILSHIRHM SNKGMEHLYSMKCK NVVPLSDLLLEMLDA HRLHAPTSRGGASVE ETDQSHLATAGSTSSH SLQKYYITGE (SEQ ID NO: 255) | NVVPLSDLL (A02.01) (SEQ ID NO: 461) NVVPLSDLLL (A02.01) (SEQ ID NO: 462) PLSDLLLEM (A02.01) (SEQ ID NO: 463) PLSDLLLEML (A02.01) (SEQ ID NO: 464) VPLSDLLLEM (B07.02) (SEQ ID NO: 465) VVPLSDLLL (A02.01, A24.02) (SEQ ID NO: 466) | Breast Cancer |
| FGFR3 | S249C | HRIGGIKLRHQQWSL VMESVVPSDRGNYTC VVENKFGSIRQTYTLD VLERCPHRPILQAGLP ANQTAVLGSDVEFHC KVYSDAQPHIQWLKH VEVNGSKVG (SEQ ID NO: 256) | VLERCPHRPI (A02.01, B08.01) (SEQ ID NO: 467) YTLDVLERC (A02.01) (SEQ ID NO: 468) | BLCA, HNSC, KIRP, LUSC |
| FRG1B | L52S | AVKLSDSRIALKSGYG KYLGINSDELVGHSD AIGPREQWEPVFQNG KMALSASNSCFIRCNE AGDIEAKSKTAGEEE MIKIRSCAEKETKKKD DIPEEDKG (SEQ ID NO: 257) | FQNGKMALS (A02.01) (SEQ ID NO: 469) | GBM, KIRP, PRAD, SKCM |
| HER2 | V777L (Resistance) | GSGAFGTVYKGIWIPD GENVKIPVAIKVLREN TSPKANKEILDEAYV MAGLGSPYVSRLLGIC LTSTVQLVTQLMPYG CLLDHVRENRGRLGS QDLLNWCM (SEQ ID NO: 258) | VMAGLGSPYV (A02.01, A03.01) (SEQ ID NO: 470) | BRCA |
| IDH1 | R132H | RVEEFKLKQMWKSPN GTIRNILGGTVFREAII CKNIPRLVSGWVKPIII GHHAYGDQYRATDF VVPGPGKVEITYTPSD GTQKVTYLVHNFEEG GGVAMGM (SEQ ID NO: 259) | KPIIIGHHA (B07.02) (SEQ ID NO: 471) | BLCA, GBM, PRAD |
| IDH1 | R132C | RVEEFKLKQMWKSPN GTIRNILGGTVFREAII CKNIPRLVSGWVKPIII GCHAYGDQYRATDFV VPGPGKVEITYTPSDG TQKVTYLVHNFEEGG GVAMGM (SEQ ID NO: 260) | KPIIIGCHA (B07.02) (SEQ ID NO: 472) | BLCA, GBM, PRAD |
| IDH1 | R132G | RVEEFKLKQMWKSPN GTIRNILGGTVFREAII CKNIPRLVSGWVKPIII GGHAYGDQYRATDF VVPGPGKVEITYTPSD GTQKVTYLVHNFEEG GGVAMGM (SEQ ID NO: 261) | KPIIIGGHA (B07.02) (SEQ ID NO: 473) | BLCA, BRCA, CRC, GBM, HNSC, LUAD, PAAD, PRAD, UCEC |
| IDH1 | R132S | RVEEFKLKQMWKSPN GTIRNILGGTVFREAII CKNIPRLVSGWVKPIII GSHAYGDQYRATDFV VPGPGKVEITYTPSDG TQKVTYLVHNFEEGG GVAMGM (SEQ ID NO: 262) | KPIIIGSHA (B07.02) (SEQ ID NO: 474) | BLCA, BRCA, GBM, HNSC, LIHC, LUAD, LUSC, PAAD, SKCM, UCEC |

TABLE 1-continued

| | | | | |
|---|---|---|---|---|
| KIT | T670I | VAVKMLKPSAHLTER EALMSELKVLSYLGN HMNIVNLLGACTIGGP TLVIIEYCCYGDLLNF LRRKRDSFICSKQEDH AEAALYKNLLHSKES SCSDSTNE (SEQ ID NO: 263) | IIEYCCYGDL (A02.01) (SEQ ID NO: 475) TIGGPTLVII (A02.01) (SEQ ID NO: 476) VIIEYCCYG (A02.01) (SEQ ID NO: 477) | Gastrointestinal stromal tumors (GIST) |
| KIT | V654A | VEATAYGLIKSDAAM TVAVKMLKPSAHLTE REALMSELKVLSYLG NHMNIANLLGACTIG GPTLVITEYCCYGDLL NFLRRKRDSFICSKQE DHAEAALYK (SEQ ID NO: 264) | HMNIANLLGA (A02.01) (SEQ ID NO: 478) IANLLGACTI (A02.01) (SEQ ID NO: 479) MNIANLLGA (A02.01) (SEQ ID NO: 480) YLGNHMNIA (A02.01, B08.01) (SEQ ID NO: 481) YLGNHMNIAN (A02.01) (SEQ ID NO: 482) | Gastrointestinal stromal tumors (GIST) |
| MEK | C121S | ISELGAGNGGVVFKVS HKPSGLVMARKLIHL EIKPAIRNQIIRELQVL HESNSPYIVGFYGAFY SDGEISICMEHMDGGS LDQVLKKAGRIPEQIL GKVSI (SEQ ID NO: 265) | VLHESNSPY (A03.01) (SEQ ID NO: 483) VLHESNSPYI (A02.01) (SEQ ID NO: 484) | Melanoma |
| MEK | P124L | LGAGNGGVVFKVSHK PSGLVMARKLIHLEIK PAIRNQIIRELQVLHEC NSLYIVGFYGAFYSDG EISICMEHMDGGSLDQ VLKKAGRIPEQILGKV SIAVI (SEQ ID NO: 266) | LQVLHECNSL (A02.01, B08.01) (SEQ ID NO: 485) LYIVGFYGAF (A24.02) (SEQ ID NO: 486) NSLYIVGFY (A01.01) (SEQ ID NO: 487) QVLHECNSL (A02.01, B08.01) (SEQ ID NO: 488) SLYIVGFYG (A02.01) (SEQ ID NO: 489) SLYIVGFYGA (A02.01) (SEQ ID NO: 490) VLHECNSLY (A03.01) (SEQ ID NO: 491) VLHECNSLYI (A02.01, A03.01) (SEQ ID NO: 492) | Melanoma |
| MYC | E39D | MPLNVSFTNRNYDLD YDSVQPYFYCDEEEN FYQQQQQSDLQPPAPS EDIWKKFELLPTPPLSP SRRSGLCSPSYVAVTP FSLRGDNDGG (SEQ ID NO: 267) | FYQQQQQSDL (A24.02) (SEQ ID NO: 493) QQQSDLQPPA (A02.01) (SEQ ID NO: 494) QQSDLQPPA (A02.01) (SEQ ID NO: 495) YQQQQQSDL (A02.01, B08.01) (SEQ ID NO: 496) | Lymphoid Cancer; Burkitt Lymphoma |
| MYC | P57S | FTNRNYDLDYDSVQP YFYCDEEENFYQQQQ QSELQPPAPSEDIWKK FELLSTPPLSPSRRSGL CSPSYVAVTPFSLRGD NDGGGGSFSTADQLE MVTELLG (SEQ ID NO: 268) | FELLSTPPL (A02.01, B08.01) (SEQ ID NO: 497) LLSTPPLSPS (A02.01) (SEQ ID NO: 498) | Lymphoid Cancer |
| MYC | T58I | TNRNYDLDYDSVQPY FYCDEEENFYQQQQQ SELQPPAPSEDIWKKF ELLPIPPLSPSRRSGLC SPSYVAVTPFSLRGDN DGGGGSFSTADQLEM VTELLGG (SEQ ID NO: 269) | FELLPIPPL (A02.01) (SEQ ID NO: 499) IWKKFELLPI (A24.02) (SEQ ID NO: 500) LLPIPPLSPS (A02.01, B07.02) (SEQ ID NO: 501) LPIPPLSPS (B07.02) (SEQ ID NO: 502) | Neuroblastoma |
| PDGFRa | T674I | VAVKMLKPTARSSEK QALMSELKIMTHLGP HLNIVNLLGACTKSGP IYIIIEYCFYGDLVNYL | IIEYCFYGDL (A02.01) (SEQ ID NO: 503) IIIEYCFYG (A02.01) (SEQ ID NO: 504) | Chronic Eosinophilic Leukemia |

TABLE 1-continued

| | | HKNRDSFLSHHPEKPK KELDIFGLNPADESTR SYVILS (SEQ ID NO: 270) | IYIIIEYCF (A24.02) (SEQ ID NO: 505) IYIIIEYCFY (A24.02) (SEQ ID NO: 506) YIIIEYCFYG (A02.01) (SEQ ID NO: 507) | |
|---|---|---|---|---|
| PIK3CA | E542K | IEEHANWSVSREAGFS YSHAGLSNRLARDNE LRENDKEQLKAISTRD PLSKITEQEKDFLWSH RHYCVTIPEILPKLLLS VKWNSRDEVAQMYC LVKDWPP (SEQ ID NO: 271) | KITEQEKDFL (A02.01) (SEQ ID NO: 508) | BLCA, BRCA, CESC, CRC, GBM, HNSC, KIRC, KIRP, LIHC, LUAD, LUSC, PRAD, UCEC |
| PIK3CA | E545K | HANWSVSREAGFSYS HAGLSNRLARDNELR ENDKEQLKAISTRDPL SEITKQEKDFLWSHRH YCVTIPEILPKLLLSVK WNSRDEVAQMYCLV KDWPPIKP (SEQ ID NO: 272) | STRDPLSEITK (A03.01) (SEQ ID NO: 509) DPLSEITK (A03.01) (SEQ ID NO: 510) | BLCA, BRCA, CESC, CRC, GBM, HNSC, KIRC, KIRP, LIHC, LUAD, LUSC, PRAD, SKCM, UCEC |
| PIK3CA | H1047R | LFINLFSMMLGSGMPE LQSFDDIAYIRKTLAL DKTEQEALEYFMKQM NDARHGGWTTKMDW IFHTIKQHALN (SEQ ID NO: 273) | | BRCA, CESC, CRC, GBM, HNSC, LIHC, LUAD, LUSC, PRAD, UCEC |
| POLE | P286R | QRGGVITDEEETSKKI ADQLDNIVDMREYDV PYHIRLSIDIETTKLPL KFRDAETDQIMMISY MIDGQGYLITNREIVS EDIEDFEFTPKPEYEGP FCVFN (SEQ ID NO: 274) | LPLKFRDAET (B07.02) (SEQ ID NO: 511) | Colorectal adenocarcinoma; Uterine/Endometrium Adenocarcinoma; Colorectal adenocarcinoma, MSI+; Uterine/Endometrium Adenocarcinoma, MSI+; Endometrioid carcinoma; Endometrium Serous carcinoma; Endometrium Carcinosarcoma- malignant mesodermal mixed tumor; Glioma; Astrocytoma; GBM |
| PTEN | R130Q | KFNCRVAQYPFEDHN PPQLELIKPFCEDLDQ WLSEDDNHVAAIHCK AGKGQTGVMICAYLL HRGKFLKAQEALDFY GEVRTRDKKGVTIPSQ RRYVYYYSY (SEQ ID NO: 275) | QTGVMICAYL (A02.01) (SEQ ID NO: 512) | BRCA, CESC, CRC, GBM, KIRC, LUSC, UCEC |
| RAC1 | P29S | MQAIKCVVVGDGAV GKTCLLISYTTNAFSG EYIPTVFDNYSANVM VDGKPVNLGLWDTA GQEDYDRLRPLSYPQ TVGET (SEQ ID NO: 276) | AFSGEYIPTV (A02.01, A24.02) (SEQ ID NO: 513) | Melanoma |
| TP53 | G245S | IRVEGNLRVEYLDDR NTFRHSVVVPYEPPEV GSDCTTIHYNYMCNS SCMGSMNRRPILTIITL EDSSGNLLGRNSFEVR VCACPGRDRRTEEEN LRKKGEP (SEQ ID NO: 277) | SMNRRPILT (A02.01, B08.01) (SEQ ID NO: 514) YMCNSSCMGS (A02.01) (SEQ ID NO: 515) | BLCA, BRCA, CRC, GBM, HNSC, LUSC, PAAD, PRAD |

| | | | | |
|---|---|---|---|---|
| TP53 | R175H | TYSPALNKMFCQLAK TCPVQLWVDSTPPPGT RVRAMAIYKQSQHMT EVVRHCPHHERCSDS DGLAPPQHLIRVEGNL RVEYLDDRNTFRHSV VVPYEPPEV (SEQ ID NO: 278) | | BLCA, BRCA, CRC, GBM, HNSC, LUAD, PAAD, PRAD, UCEC |
| TP53 | R248Q | EGNLRVEYLDDRNTF RHSVVVPYEPPEVGSD CTTIHYNYMCNSSCM GGMNQRPILTIITLEDS SGNLLGRNSFEVRVC ACPGRDRRTEEENLR KKGEPHHE (SEQ ID NO: 279) | GMNQRPILT (A02.01) (SEQ ID NO: 516) | BLCA, BRCA, CRC, GBM, HNSC, KIRC, LIHC, LUSC, PAAD, PRAD, UCEC |
| TP53 | R248W | EGNLRVEYLDDRNTF RHSVVVPYEPPEVGSD CTTIHYNYMCNSSCM GGMNWRPILTIITLED SSGNLLGRNSFEVRVC ACPGRDRRTEEENLR KKGEPHHE (SEQ ID NO: 280) | GMNWRPILT (A02.01) (SEQ ID NO: 517) | BLCA, BRCA, CRC, GBM, HNSC, LIHC, LUSC, PAAD, SKCM, UCEC |
| TP53 | R273C | PEVGSDCTTIHYNYM CNSSCMGGMNRRPIL TIITLEDSSGNLLGRNS FEVCVCACPGRDRRT EEENLRKKGEPHHELP PGSTKRALPNNTSSSP QPKKKPL (SEQ ID NO: 281) | LLGRNSFEVC (A02.01) (SEQ ID NO: 518) | BLCA, BRCA, CRC, GBM, HNSC, LUSC, PAAD, UCEC |
| TABLE 1B | | MSI-ASSOCIATED FRAMESHIFTS [1] | | |
| ACVR2A | D96fs; +1 | GVEPCYGDKDKRRHC FATWKNISGSIEIVKQ GCWLDDINCYDRTDC VEKKRQP* (SEQ ID NO: 282) | | MSI+ CRC, MSI+ Uterine/Endometrium Cancer, MSI+ Stomach Cancer, Lynch syndrome |
| ACVR2A | D96fs; -1 | GVEPCYGDKDKRRHC FATWKNISGSIEIVKQ GCWLDDINCYDRTDC VEKKTALKYIFVAVR AICVMKSFLIFRRWKS HSPLQIQLHLSHPITTS CSIPWCHLC* (SEQ ID NO: 283) | ALKYIFVAV (A02.01, B08.01) (SEQ ID NO: 519) ALKYIFVAVR (A03.01) (SEQ ID NO: 520) AVRAICVMK (A03.01) (SEQ ID NO: 521) AVRAICVMKS (A03.01) (SEQ ID NO: 522) CVEKKTALK (A03.01) (SEQ ID NO: 523) CVEKKTALKY (A01.01) (SEQ ID NO: 524) CVMKSFLIF (A24.02, B08.01) (SEQ ID NO: 525) CVMKSFLIFR (A03.01) (SEQ ID NO: 526) FLIFRRWKS (A02.01, B08.01) (SEQ ID NO: 527) FRRWKSHSPL (B08.01) (SEQ ID NO: 528) FVAVRAICV (A02.01, B08.01) (SEQ ID NO: 529) FVAVRAICVM (B08.01) (SEQ ID NO: 530) IQLHLSHPI (A02.01) (SEQ ID NO: 531) KSFLIFRRWK (A03.01) (SEQ ID NO: 532) KTALKYIFV (A02.01) (SEQ ID NO: 533) KYIFVAVRAI (A24.02) (SEQ ID NO: 534) RWKSHSPLQI (A24.02) (SEQ ID NO: 535) | MSI+ CRC, MSI+ Uterine/Endometrium Cancer, Lynch syndrome |

TABLE 1-continued

| | | | TALKYIFVAV (A02.01, B08.01) (SEQ ID NO: 536) VAVRAICVMK (A03.01) (SEQ ID NO: 537) VMKSFLIFR (A03.01) (SEQ ID NO: 538) VMKSFLIFRR (A03.01) (SEQ ID NO: 539) YIFVAVRAI (A02.01) (SEQ ID NO: 540) | |
|---|---|---|---|---|
| C15ORF40 | L132fs; +1 | TAEAVNVAIAAPPSEG EANAELCRYLSKVLE LRKSDVVLDKVGLAL FFFFFETKSCSVAQAG VQWRSLGSLQPPPPGE KLFSCLSFLSSWDYRR MPPCLANFCIFNRDGV SPCWSGWS* (SEQ ID NO: 284) | ALFFFFFET (A02.01) (SEQ ID NO: 541) ALFFFFFETK (A03.01) (SEQ ID NO: 542) AQAGVQWRSL (A02.01) (SEQ ID NO: 543) CLANFCIFNR (A03.01) (SEQ ID NO: 544) CLSFLSSWDY (A01.01, A03.01) (SEQ ID NO: 545) FFETKSCSV (B08.01) (SEQ ID NO: 546) FFFETKSCSV (A02.01) (SEQ ID NO: 547) FKLFSCLSFL (A02.01) (SEQ ID NO: 548) FLSSWDYRRM (A02.01) (SEQ ID NO: 549) GFKLFSCLSF (A24.02) (SEQ ID NO: 550) KLFSCLSFL (A02.01, A03.01) (SEQ ID NO: 551) KLFSCLSFLS (A02.01, A03.01) (SEQ ID NO: 552) LALFFFFFET (A02.01) (SEQ ID NO: 553) LFFFFFETK (A03.01) (SEQ ID NO: 554) LSFLSSWDY (A01.01) (SEQ ID NO: 555) LSFLSSWDYR (A03.01) (SEQ ID NO: 556) RMPPCLANF (A24.02) (SEQ ID NO: 557) RRMPPCLANF (A24.02) (SEQ ID NO: 558) SLQPPPPGFK (A03.01) (SEQ ID NO: 559) VQWRSLGSL (A02.01) (SEQ ID NO: 560) | MSI+ CRC, MSI+ Uterine/Endometrium Cancer, MSI+ Stomach Cancer, Lynch syndrome |
| CNOT1 | L1544fs; +1 | LSVIIFFFVYIWHWAL PLILNNHHICLMSSIIL DCNSVRQSIMSVCFFF FSVIFSTRCLTDSRYPN ICWFK* (SEQ ID NO: 285) | FFFSVIFST (A02.01) (SEQ ID NO: 561) MSVCFFFFSV (A02.01) (SEQ ID NO: 562) SVCFFFFSV (A02.01, B08.01) (SEQ ID NO: 563) SVCFFFFSVI (A02.01) (SEQ ID NO: 564) | MSI+ CRC, MSI+ Uterine/Endometrium Cancer, MSI+ Stomach Cancer, Lynch syndrome |
| CNOT1 | L1544fs; -1 | LSVIIFFFVYIWHWAL PLILNNHHICLMSSIIL DCNSVRQSIMSVCFFF FCYILNTMFDR* (SEQ ID NO: 286) | FFCYILNTMF (A24.02) (SEQ ID NO: 565) MSVCFFFFCY (A01.01) (SEQ ID NO: 566) SVCFFFFCYI (A02.01) (SEQ ID NO: 567) | MSI+ CRC, MSI+ Uterine/Endometrium Cancer, MSI+ Stomach Cancer, Lynch syndrome |
| EIF2B3 | A151fs; -1 | VLVLSCDLITDVALHE VVDLFRAYDASLAML MRKGQDSIEPVPGQK GKKKQWSSVTSLEWT AQERGCSSWLMKQT WMKSWSLRDPSYRSI LEYVSTRVLWMPTST V* (SEQ ID NO: 287) | KQWSSVTSL (A02.01) (SEQ ID NO: 568) VLWMPTSTV (A02.01) (SEQ ID NO: 569) | MSI+ CRC, MSI+ Uterine/Endometrium Cancer, MSI+ Stomach Cancer, Lynch syndrome |

TABLE 1-continued

| Gene | Mutation | Peptide Sequence | Epitope | Cancer Type |
|---|---|---|---|---|
| EPHB2 | K1020fs; -1 | SIQVMRAQMNQIQSV EGQPLARRPRATGRT KRCQPRDVTKKTCNS NDGKKREWEKRKQIL GGGGKYKEYFLKRILI RKAMTVLAGDKKGL GRFMRCVQSETKAVS LQLPLGR* (SEQ ID NO: 288) | ILIRKAMTV (A02.01) (SEQ ID NO: 570) | MSI+ CRC, MSI+ Uterine/Endometrium Cancer, MSI+ Stomach Cancer, Lynch syndrome |
| ESRP1 | N512fs; +1 | LDFLGEFATDIRTHGV HMVLNHQGRPSGDAF IQMKSADRAFMAAQK CHKKKHEGQIC* (SEQ ID NO: 289) | | MSI+ CRC, MSI+ Uterine/Endometrium Cancer, MSI+ Stomach Cancer, Lynch syndrome |
| ESRP1 | N512fs; -1 | LDFLGEFATDIRTHGV HMVLNHQGRPSGDAF IQMKSADRAFMAAQK CHKKT* (SEQ ID NO: 290) | | MSI+ CRC, MSI+ Uterine/Endometrium Cancer, MSI+ Stomach Cancer, Lynch syndrome |
| FAM111B | A273fs; -1 | GALCKDGRFRSDIGEF EWKLKEGHKKIYGKQ SMVDEVSGKVLEMDI SKKKHYNRKISIKKLN RMKVPLMKLITRV* (SEQ ID NO: 291) | RMKVPLMK (A03.01) (SEQ ID NO: 571) | MSI+ CRC, MSI+ Uterine/Endometrium Cancer, MSI+ Stomach Cancer, Lynch syndrome |
| GBP3 | T585fs; -1 | RERAQLLEEQEKTLTS KLQEQARVLKERCQG ESTQLQNEIQKLQKTL KKKPRDICRIS* (SEQ ID NO: 292) | TLKKKPRDI (B08.01) (SEQ ID NO: 572) | MSI+ CRC, MSI+ Uterine/Endometrium Cancer, MSI+ Stomach Cancer, Lynch syndrome |
| JAK1 | P861fs; +1 | VNTLKEGKRLPCPPNC PDEVYQLMRKCWEFQ PSNRTSFQNLIEGFEAL LKTSN* (SEQ ID NO: 293) | LIEGFEALLK (A03.01) (SEQ ID NO: 573) | MSI+ CRC, MSI+ Uterine/Endometrium Cancer, MSI+ Stomach Cancer, Lynch syndrome |
| JAK1 | K860fs; -1 | CRPVTPSCKELADLM TRCMNYDPNQRPFFR AIMRDINKLEEQNPDI VSEKNQQLKWTPHIL KSAS* (SEQ ID NO: 294) | QQLKWTPHI (A02.01) (SEQ ID NO: 574) QLKWTPHILK (A03.01) (SEQ ID NO: 575) IVSEKNQQLK (A03.01) (SEQ ID NO: 576) QLKWTPHILK (A03.01) (SEQ ID NO: 577) QQLKWTPHI (A24.02) (SEQ ID NO: 578) NQQLKWTPHIL (B08.01) (SEQ ID NO: 579) NQQLKWTPHI (B08.01) (SEQ ID NO: 580) QLKWTPHIL (B08.01) (SEQ ID NO: 581) | MSI+ CRC, MSI+ Uterine/Endometrium Cancer, MSI+ Stomach Cancer, Lynch syndrome |
| LMAN1 | E305fs; +1 | DDHDVLSFLTFQLTEP GKEPPTPDKEISEKEK EKYQEEFEHFQQELD KKKRGIPEGPPRPPRA ACGGNI* (SEQ ID NO: 295) | GPPRPPRAAC (B07.02) (SEQ ID NO: 582) PPRPPRAAC (B07.02) (SEQ ID NO: 583) | MSI+ CRC, MSI+ Uterine/Endometrium Cancer, MSI+ Stomach Cancer, Lynch syndrome |
| LMAN1 | E305fs; -1 | DDHDVLSFLTFQLTEP GKEPPTPDKEISEKEK EKYQEEFEHFQQELD KKKRNSRRATPTSKG SLRRKYLRV* (SEQ ID NO: 296) | SLRRKYLRV (B08.01) (SEQ ID NO: 584) | MSI+ CRC, MSI+ Uterine/Endometrium Cancer, MSI+ Stomach Cancer, Lynch syndrome |
| MSH3 | N385fs; +1 | TKSTLIGEDVNPLIKL DDAVNVDEIMTDTST SYLLCISENKENVRDK KKGQHFYWHCGSAA CHRRGCV* (SEQ ID NO: 297) | SAACHRRGCV (B08.01) (SEQ ID NO: 585) | MSI+ CRC, MSI+ Uterine/Endometrium Cancer, MSI+ Stomach Cancer, Lynch syndrome |

TABLE 1-continued

| MSH3 | K383fs; -1 | LYTKSTLIGEDVNPLI KLDDAVNVDEIMTDT STSYLLCISENKENVR DKKRATFLLALWECS LPQARLCLIVSRTLLL VQS* (SEQ ID NO: 298) | ALWECSLPQA (A02.01) (SEQ ID NO: 586) CLIVSRTLL (B08.01) (SEQ ID NO: 587) CLIVSRTLLL (A02.01, B08.01) (SEQ ID NO: 588) FLLALWECS (A02.01) (SEQ ID NO: 589) FLLALWECSL (A02.01, B08.01) (SEQ ID NO: 590) IVSRTLLLV (A02.01) (SEQ ID NO: 591) LIVSRTLLL (A02.01, B08.01) (SEQ ID NO: 592) LIVSRTLLLV (A02.01) (SEQ ID NO: 593) LLALWECSL (A02.01, B08.01) (SEQ ID NO: 594) LPQARLCLI (B08.01, B07.02) (SEQ ID NO: 595) LPQARLCLIV (B08.01) (SEQ ID NO: 596) NVRDKKRATF (B08.01) (SEQ ID NO: 597) SLPQARLCLI (A02.01, B08.01) (SEQ ID NO: 598) | MSI+CRC, MSI+ Uterine/Endometrium Cancer, MSI+ Stomach Cancer, Lynch syndrome |
| --- | --- | --- | --- | --- |
| NDUFC2 | A70fs; +1 | LPPPKLTDPRLLYIGFL GYCSGLIDNLIRRRPIA TAGLHRQLLYITAFFF CWILSCKT* (SEQ ID NO: 299) | FFCWILSCK (A03.01) (SEQ ID NO: 599) FFFCWILSCK (A03.01) (SEQ ID NO: 600) ITAFFFCWI (A02.01) (SEQ ID NO: 601) LYITAFFFCW (A24.02) (SEQ ID NO: 602) YITAFFFCWI (A02.01) (SEQ ID NO: 603) | MSI+ CRC, MSI+ Uterine/Endometrium Cancer, MSI+ Stomach Cancer, Lynch syndrome |
| NDUFC2 | F69fs; -1 | SLPPPKLTDPRLLYIGF LGYCSGLIDNLIRRRPI ATAGLHRQLLYITAFF LLDIIL* (SEQ ID NO: 300) | ITAFFLLDI (A02.01) (SEQ ID NO: 604) LLYITAFFL (A02.01, B08.01) (SEQ ID NO: 605) LLYITAFFLL (A02.01, A24.02) (SEQ ID NO: 606) LYITAFFLL (A24.02) (SEQ ID NO: 607) LYITAFFLLD (A24.02) (SEQ ID NO: 608) YITAFFLLDI (A02.01) (SEQ ID NO: 609) | MSI+ CRC, MSI+ Uterine/Endometrium Cancer, MSI+ Stomach Cancer, Lynch syndrome |
| RBM27 | Q817; +1 | NQSGGAGEDCQIFSTP GHPKMIYSSSNLKTPS KLCSGSKSHDVQEVL KKKTGSNEVTTRYEE KKTGSVRKANRMPKD VNIQVRKKQKHETRR KSKYNEDFERAWRED LTIKR* (SEQ ID NO: 301) | GSNEVTTRY (A01.01) (SEQ ID NO: 610) MPKDVNIQV (B07.02) (SEQ ID NO: 611) TGSNEVTTRY (A01.01) (SEQ ID NO: 612) | MSI+ CRC, MSI+ Uterine/Endometrium Cancer, MSI+ Stomach Cancer, Lynch syndrome |
| RPL22 | K16fs; +1 | MAPVKKLVVKGGKK KEASSEVHS* (SEQ ID NO: 302) | | MSI+ CRC, MSI+ Uterine/Endometrium Cancer, MSI+ Stomach Cancer, Lynch syndrome |
| RPL22 | K15fs; -1 | MAPVKKLVVKGGKK RSKF* (SEQ ID NO: 303) | | MSI+ CRC, MSI+ Uterine/Endometrium Cancer, MSI+ Stomach Cancer, Lynch syndrome |
| SEC31A | I462fs; +1 | MPSHQGAEQQQQQH HVFISQVVTEKEFLSR SDQLQQAVQSQGFIN YCQKKN* (SEQ ID NO: 304) | | MSI+ CRC, MSI+ Uterine/Endometrium Cancer, MSI+ Stomach Cancer, Lynch syndrome |

TABLE 1-continued

| | | | | |
|---|---|---|---|---|
| SEC31A | I462fs; -1 | MPSHQGAEQQQQQH HVFISQVVTEKEFLSR SDQLQQAVQSQGFIN YCQKKLMLLRLNLRK MCGPF* (SEQ ID NO: 305) | KKLMLLRLNL (A02.01) (SEQ ID NO: 613)<br>KLMLLRLNL (A02.01, A03.01, B07.02, B08.01) (SEQ ID NO: 614)<br>KLMLLRLNLR (A03.01) (SEQ ID NO: 615)<br>LLRLNLRKM (B08.01) (SEQ ID NO: 616)<br>LMLLRLNL (B08.01) (SEQ ID NO: 617)<br>LMLLRLNLRK (A03.01) (SEQ ID NO: 618)<br>LNLRKMCGPF (B08.01) (SEQ ID NO: 619)<br>MLLRLNLRK (A03.01) (SEQ ID NO: 620)<br>MLLRLNLRKM (A02.01, A03.01, B08.01) (SEQ ID NO: 621)<br>NLRKMCGPF (B08.01) (SEQ ID NO: 622)<br>NYCQKKLMLL (A24.02) (SEQ ID NO: 623)<br>YCQKKLMLL (B08.01) (SEQ ID NO: 624) | MSI+ CRC, MSI+ Uterine/Endometrium Cancer, MSI+ Stomach Cancer, Lynch syndrome |
| SEC63 | K530fs; +1 | AEVFEKEQSICAAEEQ PAEDGQGETNKNRTK GGWQQKSKGPKKTA KSKKKETFKKKTYTC AITTVKATETKAGKW SRWE* (SEQ ID NO: 306) | FKKKTYTCAI (B08.01) (SEQ ID NO: 625)<br>ITTVKATETK (A03.01) (SEQ ID NO: 626)<br>KSKKKETFK (A03.01) (SEQ ID NO: 627)<br>KSKKKETFKK (A03.01) (SEQ ID NO: 628)<br>KTYTCAITTV (A02.01, A24.02) (SEQ ID NO: 629)<br>TFKKKTYTC (B08.01) (SEQ ID NO: 630)<br>TYTCAITTV (A24.02) (SEQ ID NO: 631)<br>TYTCAITTVK (A03.01) (SEQ ID NO: 632)<br>YTCAITTVK (A03.01) (SEQ ID NO: 633) | MSI+ CRC, MSI+ Uterine/Endometrium Cancer, MSI+ Stomach Cancer, Lynch syndrome |
| SEC63 | K529fs; -1 | MAEVFEKEQSICAAEE QPAEDGQGETNKNRT KGGWQQKSKGPKKT AKSKKRNL* (SEQ ID NO: 307) | TAKSKKRNL (B08.01) (SEQ ID NO: 634) | MSI+ CRC, MSI+ Uterine/Endometrium Cancer, MSI+ Stomach Cancer, Lynch syndrome |
| SLC35F5 | C248fs; -1 | NIMEIRQLPSSHALEA KLSRMSYPVKEQESIL KTVGKLTATQVAKISF FFALCGFWQICHIKKH FQTHKLL* (SEQ ID NO: 308) | FALCGFWQI (A02.01) (SEQ ID NO: 635) | MSI+ CRC, MSI+ Uterine/Endometrium Cancer, MSI+ Stomach Cancer, Lynch syndrome |
| SMAP1 | K172fs; +1 | YEKKKYYDKNAIAIT NISSSDAPLQPLVSSPS LQAAVDKNKLEKEKE KKKGREKERKGARKA GKTTYS* (SEQ ID NO: 309) | | MSI+ CRC, MSI+ Uterine/Endometrium Cancer, MSI+ Stomach Cancer, Lynch syndrome |
| SMAP1 | K171fs; -1 | KYEKKKYYDKNAIAI TNISSSDAPLQPLVSSP SLQAAVDKNKLEKEK EKKRKRKREKRSQKS RQNHLQLKSCRRKISN WSLKKVPALKKLRSP LWIF* (SEQ ID NO: 310) | LKKLRSPL (B08.01) (SEQ ID NO: 636)<br>SLKKVPAL (B08.01) (SEQ ID NO: 637)<br>RKISNWSLKK (A03.01) (SEQ ID NO: 638)<br>VPALKKLRSPL (B07.02) (SEQ ID NO: 639) | MSI+ CRC, MSI+ Uterine/Endometrium Cancer, MSI+ Stomach Cancer, Lynch syndrome |

TABLE 1-continued

| | | | | |
|---|---|---|---|---|
| TFAM | E148fs; +1 | IYQDAYRAEWQVYKE EISRFKEQLTPSQIMSL EKEIMDKHLKRKAMT KKKRVNTAWKTKKT SFSL* (SEQ ID NO: 311) | KRVNTAWKTK (A03.01) (SEQ ID NO: 640) MTKKKRVNTA (B08.01) (SEQ ID NO: 641) RVNTAWKTK (A03.01) (SEQ ID NO: 642) RVNTAWKTKK (A03.01) (SEQ ID NO: 643) TKKKRVNTA (B08.01) (SEQ ID NO: 644) WKTKKTSFSL (B08.01) (SEQ ID NO: 645) | MSI+ CRC, MSI+ Uterine/Endometrium Cancer, MSI+ Stomach Cancer, Lynch syndrome |
| TFAM | E148fs; -1 | IYQDAYRAEWQVYKE EISRFKEQLTPSQIMSL EKEIMDKHLKRKAMT KKKS* (SEQ ID NO: 312) | | MSI+ CRC, MSI+ Uterine/Endometrium Cancer, MSI+ Stomach Cancer, Lynch syndrome |
| TGFBR2 | P129fs; +1 | KPQEVCVAVWRKND ENITLETVCHDPKLPY HDFILEDAASPKCIMK EKKKAW* (SEQ ID NO: 313) | | MSI+ CRC, MSI+ Uterine/Endometrium Cancer, MSI+ Stomach Cancer, Lynch syndrome |
| TGFBR2 | K128fs: -1 | EKPQEVCVAVWRKN DENITLETVCHDPKLP YHDFILEDAASPKCIM KEKKSLVRLSSCVPVA LMSAMTTSSSQKNITP AILTCC* (SEQ ID NO: 314) | ALMSAMTTS (A02.01) (SEQ ID NO: 646) AMTTSSSQK (A03.01, A11.01) (SEQ ID NO: 647) AMTTSSSQKN (A03.01) (SEQ ID NO: 648) CIMKEKKSL (B08.01) (SEQ ID NO: 649) CIMKEKKSLV (B08.01) (SEQ ID NO: 650) IMKEKKSL (B08.01) (SEQ ID NO: 651) IMKEKKSLV (B08.01) (SEQ ID NO: 652) KSLVRLSSCV (A02.01) (SEQ ID NO: 653) LVRLSSCVPV (A02.01) (SEQ ID NO: 654) RLSSCVPVA (A02.01, A03.01) (SEQ ID NO: 655) RLSSCVPVAL (A02.01) (SEQ ID NO: 656) SAMTTSSSQK (A03.01, A11.01) (SEQ ID NO: 657) SLVRLSSCV (A02.01) (SEQ ID NO: 658) VPVALMSAM (B07.02) (SEQ ID NO: 659) VRLSSCVPVA (A02.01) (SEQ ID NO: 660) | MSI+ CRC, MSI+ Uterine/Endometrium Cancer, MSI+ Stomach Cancer, Lynch syndrome |
| THAP5 | K99fs; -1 | VPSKYQFLCSDHFTPD SLDIRWGIRYLKQTAV PTIFSLPEDNQGKDPS KKNPRRKTWKMRKK YAQKPSQKNHLY* (SEQ ID NO: 315) | KMRKKYAQK (A03.01) (SEQ ID NO: 661) | MSI+ CRC, MSI+ Uterine/Endometrium Cancer, MSI+ Stomach Cancer, Lynch syndrome |
| TTK | R854fs; -1 | GTTEEMKYVLGQLVG LNSPNSILKAAKTLYE HYSGGESHNSSSSKTF EKKGEKNDLQLFVMS DTTYKIYWTVILLNPC GNLHLKTTSL* (SEQ ID NO: 316) | FVMSDTTYK (A03.01) (SEQ ID NO: 662) FVMSDTTYKI (A02.01) (SEQ ID NO: 663) KTFEKKGEK (A03.01) (SEQ ID NO: 664) LFVMSDTTYK (A03.01) (SEQ ID NO: 665) MSDTTYKIY (A01.01) (SEQ ID NO: 666) VMSDTTYKI (A02.01) (SEQ ID NO: 667) VMSDTTYKIY (A01.01) (SEQ ID NO: 668) | MSI+ CRC, MSI+ Uterine/Endometrium Cancer, MSI+ Stomach Cancer, Lynch syndrome |

TABLE 1-continued

| | | | | |
|---|---|---|---|---|
| XPOT | F126fs; -1 | QQLIRETLISWLQAQM LNPQPEKTFIRNKAAQ VFALLFVTEYLTKWP KFFLTFSQ* (SEQ ID NO: 317) | YLTKWPKFFL (A02.01) (SEQ ID NO: 669) | MSI+ CRC, MSI+ Uterine/Endometrium Cancer, MSI+ Stomach Cancer, Lynch syndrome |
| TABLE 1C | | FRAMESHIFT [1] | | |
| APC | V1352fs F1354fs Q1378fs S1398fs | AKFQQCHSTLEPNPA DCRVLVYLQNQPGTK LLNFLQERNLPPKVVL RHPKVHLNTMFRRPH SCLADVLLSVHLIVLR VVRLPAPFRVNHAVE W* (SEQ ID NO: 318) | FLQERNLPP (A02.01) (SEQ ID NO: 670) FRRPHSCLA (B08.01) (SEQ ID NO: 671) LIVLRVVRL (B08.01) (SEQ ID NO: 672) LLSVHLIVL (A02.01, B08.01) (SEQ ID NO: 673) | CRC, LUAD, UCEC, STAD |
| APC | S1421fs R1435fs T1438fs P1442fs P1443fs V1452fs P1453fs K1462fs E1464fs | APVIFQIALDKPCHQA EVKHLHHLLKQLKPS EKYLKIKHLLLKRERV DLSKLQ* (SEQ ID NO: 319) | EVKHLHHLL (B08.01) (SEQ ID NO: 674) HLHHHLLKQLK (A03.01) (SEQ ID NO: 675) HLLLKRERV (B08.01) (SEQ ID NO: 676) KIKHLLLKR (A03.01) (SEQ ID NO: 677) KPSEKYLKI (B07.02) (SEQ ID NO: 678) KYLKIKHLL (A24.02) (SEQ ID NO: 679) KYLKIKHLLL (A24.02) (SEQ ID NO: 680) LLKQLKPSEK (A03.01) (SEQ ID NO: 681) LLKRERVDL (B08.01) (SEQ ID NO: 682) LLLKRERVDL (B08.01) (SEQ ID NO: 683) QLKPSEKYLK (A03.01) (SEQ ID NO: 684) YLKIKHLLL (A02.01, B08.01) (SEQ ID NO: 685) YLKIKHLLLK (A03.01) (SEQ ID NO: 686) | CRC, LUAD, UCEC, STAD |
| APC | T1487fs H1490fs L1488fs | MLQFRGSRFFQMLILY YILPRKVLQMDFLVHP A* (SEQ ID NO: 320) | ILPRKVLQM (B08.01) (SEQ ID NO: 687) KVLQMDFLV (A02.01, A24.02) (SEQ ID NO: 688) LPRKVLQMDF (B07.02, B08.01) (SEQ ID NO: 689) LQMDFLVHPA (A02.01) (SEQ ID NO: 690) QMDFLVHPA (A02.01) (SEQ ID NO: 691) YILPRKVLQM (A02.01, B08.01) (SEQ ID NO: 692) | CRC, LUAD, UCEC, STAD |
| ARID1A | Q1306fs S1316fs Y1324fs T1348fs G1351fs G1378fs P1467fs | ALGPHSRISCLPTQTR GCILLAATPRSSSSSS NDMIPMAISSPPKAPL LAAPSPASRLQCINSN SRITSGQWMAHMALL PSGTKGRCTACHTAL GRGSLSSSSCPQPSPSL PASNKLPSLPLSKMYT TSMAMPILPLPQLLLS ADQQAAPRTNFHSSL AETVSLHPLAPMPSKT CHHK* (SEQ ID NO: 321) | APSPASRLQC (B07.02) (SEQ ID NO: 693) HPLAPMPSKT (B07.02) (SEQ ID NO: 694) ILPLPQLLL (A02.01) (SEQ ID NO: 695) LLLSADQQA (A02.01) (SEQ ID NO: 696) LPTQTRGCI (B07.02) (SEQ ID NO: 697) LPTQTRGCIL (B07.02) (SEQ ID NO: 698) RISCLPTQTR (A03.01) (SEQ ID NO: 699) SLAETVSLH (A03.01) (SEQ ID NO: 700) TPRSSSSSS (B07.02) (SEQ ID NO: 701) TPRSSSSSSS (B07.02) (SEQ ID NO: 702) | STAD, UCEC, BLCA, BRCA, LUSC, CESC, KIRC, UCS |

TABLE 1-continued

| | | | | |
|---|---|---|---|---|
| ARID1A | S674fs<br>P725fs<br>R727fs<br>I736fs | AHQGFPAAKESRVIQL<br>SLLSLLIPPLTCLASEA<br>LPRPLLALPPVLLSLA<br>QDHSRLLQCQATRCH<br>LGHPVASRTASCILP*<br>(SEQ ID NO: 322) | ALPPVLLSL (A02.01) (SEQ ID NO: 703)<br>ALPPVLLSLA (A02.01) (SEQ ID NO: 704)<br>ALPRPLLAL (A02.01) (SEQ ID NO: 705)<br>ASRTASCIL (B07.02) (SEQ ID NO: 706)<br>EALPRPLLAL (B08.01) (SEQ ID NO: 707)<br>HLGHPVASR (A03.01) (SEQ ID NO: 708)<br>HPVASRTAS (B07.02) (SEQ ID NO: 709)<br>HPVASRTASC (B07.02) (SEQ ID NO: 710)<br>IIQLSLLSLL (A02.01) (SEQ ID NO: 711)<br>IQLSLLSLL (A02.01) (SEQ ID NO: 712)<br>IQLSLLSLLI (A02.01, A24.02) (SEQ ID NO: 713)<br>LLALPPVLL (A02.01) (SEQ ID NO: 714)<br>LLIPPLTCL (A02.01) (SEQ ID NO: 715)<br>LLIPPLTCLA (A02.01) (SEQ ID NO: 716)<br>LLSLLIPPL (A02.01) (SEQ ID NO: 717)<br>LLSLLIPPLT (A02.01) (SEQ ID NO: 718)<br>LPRPLLALPP (B07.02) (SEQ ID NO: 719)<br>QLSLLSLLI (A02.01) (SEQ ID NO: 720)<br>RLLQCQATR (A03.01) (SEQ ID NO: 721)<br>RPLLALPPV (B07.02) (SEQ ID NO: 722)<br>RPLLALPPVL (B07.02) (SEQ ID NO: 723)<br>SLAQDHSRL (A02.01) (SEQ ID NO: 724)<br>SLAQDHSRLL (A02.01) (SEQ ID NO: 725)<br>SLLIPPLTCL (A02.01) (SEQ ID NO: 726)<br>SLLSLLIPP (A02.01) (SEQ ID NO: 727)<br>SLLSLLIPPL (A02.01, B08.01) (SEQ ID NO: 728) | STAD, UCEC, BLCA, BRCA, LUSC, CESC, KIRC, UCS |
| ARID1A | G414fs<br>Q473fs<br>H477fs<br>S499fs<br>P504fs<br>Q548fs<br>P549fs | PILAATGTSVRTAART<br>WVPRAAIRVPDPAAV<br>PDDHAGPGAECHGRP<br>LLYTADSSLWTTRPQ<br>RVWSTGPDSILQPAKS<br>SPSAAAATLLPATTVP<br>DPSCPTFVSAAATVST<br>TTAPVLSASILPAAIPA<br>STSAVPGSIPLPAVDD<br>TAAPPEPAPLLTATGS<br>VSLPAAATSAASTLDA<br>LPAGCVSSAPVSAVPA<br>NCLFPAALPSTAGAIS<br>RFIWVSGILSPLNDLQ*<br>(SEQ ID NO: 323) | AAATSAASTL (B07.02) (SEQ ID NO: 729)<br>AAIPASTSAV (B07.02) (SEQ ID NO: 730)<br>AIPASTSAV (A02.01) (SEQ ID NO: 731)<br>ALPAGCVSSA (A02.01) (SEQ ID NO: 732)<br>APLLTATGSV (B07.02) (SEQ ID NO: 733)<br>APVLSASIL (B07.02) (SEQ ID NO: 734)<br>ATLLPATTV (A02.01) (SEQ ID NO: 735)<br>ATVSTTTAPV (A02.01) (SEQ ID NO: 736)<br>AVPANCLFPA (A02.01) (SEQ ID NO: 737)<br>CLFPAALPST (A02.01) (SEQ ID NO: 738)<br>CPTFVSAAA (B07.02) (SEQ ID NO: 739)<br>FPAALPSTA (B07.02) (SEQ ID NO: 740)<br>FPAALPSTAG (B07.02) (SEQ ID NO: 741) | STAD, UCEC, BLCA, BRCA, LUSC, CESC, KIRC, UCS |

TABLE 1-continued

|  |  |  |  | GAECHGRPL (B07.02) (SEQ ID NO: 742)<br>GAISRFIWV (A02.01) (SEQ ID NO: 743)<br>ILPAAIPAST (A02.01) (SEQ ID NO: 744)<br>IWVSGILSPL (A24.02) (SEQ ID NO: 745)<br>LLTATGSVSL (A02.01) (SEQ ID NO: 746)<br>LLYTADSSL (A02.01) (SEQ ID NO: 747)<br>LPAAATSAA (B07.02) (SEQ ID NO: 748)<br>LPAAATSAAS (B07.02) (SEQ ID NO: 749)<br>LPAAIPAST (B07.02) (SEQ ID NO: 750)<br>LPAGCVSSA (B07.02) (SEQ ID NO: 751)<br>LPAGCVSSAP (B07.02) (SEQ ID NO: 752)<br>LYTADSSLW (A24.02) (SEQ ID NO: 753)<br>QPAKSSPSA (B07.02) (SEQ ID NO: 754)<br>QPAKSSPSAA (B07.02) (SEQ ID NO: 755)<br>RFIWVSGIL (A24.02) (SEQ ID NO: 756)<br>RPQRVWSTG (B07.02) (SEQ ID NO: 757)<br>RVWSTGPDSI (A02.01) (SEQ ID NO: 758)<br>SAVPGSIPL (B07.02) (SEQ ID NO: 759)<br>SILPAAIPA (A02.01) (SEQ ID NO: 760)<br>SLPAAATSA (A02.01) (SEQ ID NO: 761)<br>SLPAAATSAA (A02.01) (SEQ ID NO: 762)<br>SLWTTRPQR (A03.01) (SEQ ID NO: 763)<br>SLWTTRPQRV (A02.01) (SEQ ID NO: 764)<br>SPSAAAATL (B07.02) (SEQ ID NO: 765)<br>SPSAAAATLL (B07.02) (SEQ ID NO: 766)<br>TLDALPAGCV (A02.01) (SEQ ID NO: 767)<br>TVSTTTAPV (A02.01) (SEQ ID NO: 768)<br>VLSASILPA (A02.01) (SEQ ID NO: 769)<br>VLSASILPAA (A02.01) (SEQ ID NO: 770)<br>VPANCLFPA (B07.02) (SEQ ID NO: 771)<br>VPANCLFPAA (B07.02) (SEQ ID NO: 772)<br>VPDPSCPTF (B07.02) (SEQ ID NO: 773)<br>VPGSIPLPA (B07.02) (SEQ ID NO: 774)<br>VPGSIPLPAV (B07.02) (SEQ ID NO: 775)<br>WVSGILSPL (A02.01) (SEQ ID NO: 776)<br>YTADSSLWTT (A02.01) (SEQ ID NO: 777) |  |
| ARID1A | T433fs<br>A441fs<br>Y447fs<br>P483fs<br>P484fs<br>P504fs<br>S519fs | PCRAGRRVPWAASLI<br>HSRFLLMDNKAPAGM<br>VNRARLHITTSKVLTL<br>SSSSHPTPSNHRPRPL<br>MPNLRISSSHSLNHHS<br>SSPLSLHTPSSHPSLHI<br>SSPRLHTPPSSRRHSST | APAGMVNRA (B07.02) (SEQ ID NO: 778)<br>ASLHRRSYL (B08.01) (SEQ ID NO: 779)<br>ASLHRRSYLK (A03.01) (SEQ ID NO: 780)<br>FLLMDNKAPA (A02.01) | STAD, UCEC, BLCA, BRCA, LUSC, CESC, KIRC, UCS |

TABLE 1-continued

| | | |
|---|---|---|
| H544fs | PRASPPTHSHRLSLLTS | (SEQ ID NO: 781) |
| P549fs | SSNLSSQHPRRSPSRL | HPRRSPSRL (B07.02, B08.01) |
| P554fs | RILSPSLSSPSKLPIPSS | (SEQ ID NO: 782) |
| Q563fs | ASLHRRSYLKIHLGLR | HPSLHISSP (B07.02) (SEQ ID NO: 783) |
| | HPQPPQ* (SEQ ID NO: 324) | HRRSYLKIHL (B08.01) (SEQ ID NO: 784) |
| | | HSRFLLMDNK (A03.01) (SEQ ID NO: 785) |
| | | KLPIPSSASL (A02.01) (SEQ ID NO: 786) |
| | | KVLTLSSSSH (A03.01) (SEQ ID NO: 787) |
| | | LIHSRFLLM (B08.01) (SEQ ID NO: 788) |
| | | LLMDNKAPA (A02.01) (SEQ ID NO: 789) |
| | | LMDNKAPAGM (A02.01) (SEQ ID NO: 790) |
| | | LPIPSSASL (B07.02) (SEQ ID NO: 791) |
| | | MPNLRISSS (B07.02, B08.01) (SEQ ID NO: 792) |
| | | MPNLRISSSH (B07.02) (SEQ ID NO: 793) |
| | | NLRISSSHSL (B07.02, B08.01) (SEQ ID NO: 794) |
| | | PPTHSHRLSL (B07.02) (SEQ ID NO: 795) |
| | | RAGRRVPWAA (B08.01) (SEQ ID NO: 796) |
| | | RARLHITTSK (A03.01) (SEQ ID NO: 797) |
| | | RISSSHSLNH (A03.01) (SEQ ID NO: 798) |
| | | RLHTPPSSR (A03.01) (SEQ ID NO: 799) |
| | | RLHTPPSSRR (A03.01) (SEQ ID NO: 800) |
| | | RLRILSPSL (A02.01, B07.02, B08.01) (SEQ ID NO: 801) |
| | | RPLMPNLRI (B07.02) (SEQ ID NO: 802) |
| | | RPRPLMPNL (B07.02) (SEQ ID NO: 803) |
| | | SASLHRRSYL (B07.02, B08.01) (SEQ ID NO: 804) |
| | | SLHISSPRL (A02.01) (SEQ ID NO: 805) |
| | | SLHRRSYLK (A03.01) (SEQ ID NO: 806) |
| | | SLHRRSYLKI (B08.01) (SEQ ID NO: 807) |
| | | SLIHSRFLL (A02.01) (SEQ ID NO: 808) |
| | | SLIHSRFLLM (A02.01, B08.01) (SEQ ID NO: 809) |
| | | SLLTSSSNL (A02.01) (SEQ ID NO: 810) |
| | | SLNHHSSSPL (A02.01, B07.02, B08.01) (SEQ ID NO: 811) |
| | | SLSSPSKLPI (A02.01) (SEQ ID NO: 812) |
| | | SPLSLHTPS (B07.02) (SEQ ID NO: 813) |
| | | SPLSLHTPSS (B07.02) (SEQ ID NO: 814) |
| | | SPPTHSHRL (B07.02) (SEQ ID NO: 815) |
| | | SPRLHTPPS (B07.02) (SEQ ID NO: 816) |
| | | SPRLHTPPSS (B07.02) (SEQ ID NO: 817) |
| | | SPSLSSPSKL (B07.02) (SEQ ID NO: 818) |

TABLE 1-continued

| | | | SYLKIHLGL (A24.02) (SEQ ID NO: 819) TPSNHRPRPL (B07.02, B08.01) (SEQ ID NO: 820) TPSSHPSLHI (B07.02) (SEQ ID NO: 821) | |
|---|---|---|---|---|
| ARIDIA | A2137fs P2139fs L1970fs V1994fs | RTNPTVRMRPHCVPF WTGRILLPSAASVCPIP FEACHLCQAMTLRCP NTQGCCSSWAS* (SEQ ID NO: 325) | CVPFWTGRIL (B07.02) (SEQ ID NO: 822) HCVPFWTGRIL (B07.02) (SEQ ID NO: 823) ILLPSAASV (A02.01) (SEQ ID NO: 824) ILLPSAASVC (A02.01) (SEQ ID NO: 825) LLPSAASVCPI (A02.01) (SEQ ID NO: 826) LPSAASVCPI (B07.02) (SEQ ID NO: 827) MRPHCVPF (B08.01) (SEQ ID NO: 828) RILLPSAASV (A02.01) (SEQ ID NO: 829) RMRPHCVPF (A24.02, B07.02, B08.01) (SEQ ID NO: 830) RMRPHCVPFW (A24.02) (SEQ ID NO: 831) RTNPTVRMR (A03.01) (SEQ ID NO: 832) SVCPIPFEA (A02.01) (SEQ ID NO: 833) TVRMRPHCV (B08.01) (SEQ ID NO: 834) TVRMRPHCVPF (B08.01) (SEQ ID NO: 835) VPFWTGRIL (B07.02) (SEQ ID NO: 836) VPFWTGRILL (B07.02) (SEQ ID NO: 837) VRMRPHCVPF (B08.01) (SEQ ID NO: 838) | STAD, UCEC, BLCA, BRCA, LUSC, CESC, KIRC, UCS |
| ARIDIA | N756fs S764fs T783fs Q799fs A817fs | TNQALPKIEVICRGTP RCPSTVPPSPAQPYLR VSLPEDRYTQAWAPT SRTPWGAMVPRGVS MAHKVATPGSQTIMP CPMPTTPVQAWLEA* (SEQ ID NO: 326) | AMVPRGVSM (B07.02, B08.01) (SEQ ID NO: 839) AMVPRGVSMA (A02.01) (SEQ ID NO: 840) AWAPTSRTPW (A24.02) (SEQ ID NO: 841) CPMPTTPVQA (B07.02) (SEQ ID NO: 842) CPSTVPPSPA (B07.02) (SEQ ID NO: 843) GAMVPRGVSM (B07.02, B08.01) (SEQ ID NO: 844) MPCPMPTTPV (B07.02) (SEQ ID NO: 845) MPTTPVQAW (B07.02) (SEQ ID NO: 846) MPTTPVQAWL (B07.02) (SEQ ID NO: 847) SLPEDRYTQA (A02.01) (SEQ ID NO: 848) SPAQPYLRV (B07.02) (SEQ ID NO: 849) SPAQPYLRVS (B07.02) (SEQ ID NO: 850) TIMPCPMPT (A02.01) (SEQ ID NO: 851) TPVQAWLEA (B07.02) (SEQ ID NO: 852) TSRTPWGAM (B07.02) (SEQ ID NO: 853) VPPSPAQPYL (B07.02) (SEQ ID NO: 854) VPRGVSMAH (B07.02) (SEQ ID NO: 855) | STAD, UCEC, BLCA, BRCA, LUSC, CESC, KIRC, UCS |

TABLE 1-continued

| | | | | |
|---|---|---|---|---|
| β2M | N62fs<br>E67fs<br>L74fs<br>F82fs<br>T91fs<br>E94fs | RMERELKKWSIQTCL<br>SARTGLSISCTTLNSPP<br>LKKMSMPAV* (SEQ<br>ID NO: 327) | CLSARTGLSI (B08.01) (SEQ ID NO: 856)<br>CTTLNSPPLK (A03.01) (SEQ ID NO: 857)<br>GLSISCTTL (A02.01) (SEQ ID NO: 858)<br>SPPLKKMSM (B07.02, B08.01) (SEQ ID NO: 859)<br>TLNSPPLKK (A03.01) (SEQ ID NO: 860)<br>TTLNSPPLK (A03.01) (SEQ ID NO: 861)<br>TTLNSPPLKK (A03.01) (SEQ ID NO: 862) | CRC, STAD, SKCM, HNSC |
| β2M | L13fs<br>S14fs | LCSRYSLFLAWRLSSV<br>LQRFRFTHVIQQRMES<br>QIS* (SEQ ID NO: 328) | LQRFRFTHV (B08.01) (SEQ ID NO: 863)<br>LQRFRFTHVI (B08.01) (SEQ ID NO: 864)<br>RLSSVLQRF (A24.02) (SEQ ID NO: 865)<br>RLSSVLQRFR (A03.01) (SEQ ID NO: 866)<br>VLQRFRFTHV (A02.01, B08.01) (SEQ ID NO: 867) | CRC, STAD, SKCM, HNSC |
| CDH1 | A691fs<br>P708fs<br>L711fs | RSACVTVKGPLASVG<br>RHSLSKQDCKFLPFW<br>GFLEEFLLC* (SEQ ID NO: 329) | ASVGRHSLSK (A03.01) (SEQ ID NO: 868)<br>KFLPFWGFL (A24.02) (SEQ ID NO: 869)<br>LASVGRHSL (B07.02) (SEQ ID NO: 870)<br>LPFWGFLEEF (B07.02) (SEQ ID NO: 871)<br>PFWGFLEEF (A24.02) (SEQ ID NO: 872)<br>SVGRHSLSK (A03.01) (SEQ ID NO: 873) | ILC LumA Breast Cancer |
| CDH1 | H121fs<br>P126fs<br>H128fs<br>N144fs<br>V157fs<br>P159fs<br>N166fs<br>N181fs<br>F189fs<br>P201fs<br>F205fs | IQWGTTTAPRPIRPPFL<br>ESKQNCSHFPTPLLAS<br>EDRRETGLFLPSAAQK<br>MKKAHFLKTWFRSNP<br>TKTKKARFSTASLAKE<br>LTHPLLVSLLLKEKQD<br>G* (SEQ ID NO: 330) | APRPIRPPF (B07.02) (SEQ ID NO: 874)<br>APRPIRPPFL (B07.02) (SEQ ID NO: 875)<br>AQKMKKAHFL (B08.01) (SEQ ID NO: 876)<br>FLPSAAQKM (A02.01) (SEQ ID NO: 877)<br>GLFLPSAAQK (A03.01) (SEQ ID NO: 878)<br>HPLLVSLLL (B07.02) (SEQ ID NO: 879)<br>KAHFLKTWFR (A03.01) (SEQ ID NO: 880)<br>KARFSTASL (B07.02) (SEQ ID NO: 881)<br>KMKKAHFLK (A03.01) (SEQ ID NO: 882)<br>KTWFRSNPTK (A03.01) (SEQ ID NO: 883)<br>LAKELTHPL (B07.02, B08.01) (SEQ ID NO: 884)<br>LAKELTHPLL (B08.01) (SEQ ID NO: 885)<br>NPTKTKKARF (B07.02) (SEQ ID NO: 886)<br>QKMKKAHFL (B08.01) (SEQ ID NO: 887)<br>RFSTASLAK (A03.01) (SEQ ID NO: 888)<br>RPIRPPFLES (B07.02) (SEQ ID NO: 889)<br>RSNPTKTKK (A03.01) (SEQ ID NO: 890)<br>SLAKELTHPL (A02.01, B08.01) (SEQ ID NO: 891)<br>TKKARFSTA (B08.01) (SEQ ID NO: 892) | ILC LumA Breast Cancer |

TABLE 1-continued

| | | | | |
|---|---|---|---|---|
| CDH1 | V114fs<br>P127fs<br>V132fs<br>P160fs | PTDPFLGLRLGLHLQK<br>VFHQSHAEYSGAPPPP<br>PAPSGLRFWNPSRIAH<br>ISQLLSWPQKTEERLG<br>YSSHQLPRK* (SEQ ID<br>NO: 331) | GLRFWNPSR (A03.01) (SEQ<br>ID NO: 893)<br>ISQLLSWPQK (A03.01) (SEQ<br>ID NO: 894)<br>RIAHISQLL (A02.01) (SEQ<br>ID NO: 895)<br>RLGYSSHQL (A02.01) (SEQ<br>ID NO: 896)<br>SQLLSWPQK (A03.01) (SEQ<br>ID NO: 897)<br>SRIAHISQL (B08.01) (SEQ ID<br>NO: 898)<br>WPQKTEERL (B07.02) (SEQ<br>ID NO: 899)<br>YSSHQLPRK (A03.01) (SEQ<br>ID NO: 900) | ILC LumA Breast Cancer |
| CDH1 | L731fs<br>R749fs<br>E757fs<br>G759fs | FCCSCCFFGGERWSKS<br>PYCPQRMTPGTTFITM<br>MKKEAEKRTRTLT*<br>(SEQ ID NO: 332) | CPQRMTPGTT (B07.02) (SEQ<br>ID NO: 901)<br>EAEKRTRTL (B08.01) (SEQ<br>ID NO: 902)<br>GTTFITMMK (A03.01) (SEQ<br>ID NO: 903)<br>GTTFITMMKK (A03.01)<br>(SEQ ID NO: 904)<br>ITMMKKEAEK (A03.01)<br>(SEQ ID NO: 905)<br>RMTPGTTFI (A02.01) (SEQ<br>ID NO: 906)<br>SPYCPQRMT (B07.02) (SEQ<br>ID NO: 907)<br>TMMKKEAEK (A03.01) (SEQ<br>ID NO: 908)<br>TPGTTFITM (B07.02) (SEQ<br>ID NO: 909)<br>TPGTTFITMM (B07.02)<br>(SEQ ID NO: 910)<br>TTFITMMKK (A03.01) (SEQ<br>ID NO: 911) | ILC LumA Breast Cancer |
| CDH1 | S19fs<br>E24fs<br>S36fs | WRRNCKAPVSLRKSV<br>QTPARSSPARPDRTRR<br>LPSLGVPGQPWALGA<br>AASRRCCCCCRSPLGS<br>ARSRSPATLALTPRAT<br>RSRCPGATWREAASW<br>AE* (SEQ ID NO: 333) | CPGATWREA (B07.02) (SEQ<br>ID NO: 912)<br>CPGATWREAA (B07.02)<br>(SEQ ID NO: 913)<br>RSRCPGATWR (A03.01)<br>(SEQ ID NO: 914)<br>TPRATRSRC (B07.02) (SEQ<br>ID NO: 915) | ILC LumA Breast Cancer |
| GATA3 | P394fs<br>P387fs<br>S398fs<br>H400fs<br>M401fs<br>S408fs<br>P409fs<br>S408fs<br>P409fs<br>T419fs<br>H424fs<br>P425fs<br>S427fs<br>F431fs<br>S430fs<br>H434fs<br>H435fs<br>S438fs<br>M443fs<br>G444fs<br>*445fs | PGRPLQTHVLPEPHLA<br>LQPLQPHADHAHADA<br>PAIQPVLWTTPPLQHG<br>HRHGLEPCSMLTGPP<br>ARVPAVPFDLHFCRSS<br>IMKPKRDGYMFLKAE<br>SKIMFATLQRSSLWCL<br>CSNH* (SEQ ID NO:<br>334) | HVLPEPHLAL (B07.02) (SEQ<br>ID NO: 916)<br>RPLQTHVLPE (B07.02) (SEQ<br>ID NO: 917)<br>VLWTTPPLQH (A03.01)<br>(SEQ ID NO: 918) | Breast Cancer |
| GATA3 | P426fs<br>H434fs<br>P433fs<br>T441fs | PRPRRCTRHPACPLDH<br>TTPPAWSPPWVRALL<br>DAHRAPSESPCSPFRL<br>AFLQEQYHEA* (SEQ<br>ID NO: 335) | APSESPCSPF (B07.02) (SEQ<br>ID NO: 919)<br>CPLDHTTPPA (B07.02) (SEQ<br>ID NO: 920)<br>FLQEQYHEA (A02.01,<br>B08.01) (SEQ ID NO: 921)<br>RLAFLQEQYH (A03.01)<br>(SEQ ID NO: 922) | Breast Cancer |

TABLE 1-continued

| | | | | |
|---|---|---|---|---|
| | | | SPCSPFRLAF (B07.02) (SEQ ID NO: 923) | |
| | | | SPPWVRALL (B07.02) (SEQ ID NO: 924) | |
| | | | YPACPLDHTT (B07.02) (SEQ ID NO: 925) | |
| MLL2 | P519fs E524fs P647fs S654fs L656fs R755fs L761fs Q773fs | TRRCHCCPHLRSHPCP HHLRNHPRPHHLRHH ACHHHLRNCPHPHFL RHCTCPGRWRNRPSL RRLRSLLCLPHLNHHL FLHWRSRPCLHRKSH PHLLHLRRLYPHHLK HRPCPHHLKNLLCPR HLRNCPLPRHLKHLA CLHHLRSHPCPLHLKS HPCLHHRRHLVCSHH LKSLLCPLHLRSLPFP HHLRHHACPHHLRTR LCPHHLKNHLCPPHLR YRAYPPCLWCHACLH RLRNLPCPHRLRSLPR PLHLRLHASPHHLRTP PHPHHLRTHLLPHHRR TRSCPCRWRSHPCCH YLRSRNSAPGPRGRTC HPGLRSRTCPPGLRSH TYLRRLRSHTCPPSLR SHAYALCLRSHTCPPR LRDHICPLSLRNCTCP PRLRSRTCLLCLRSHA CPPNLRNHTCPPSLRS HACPPGLRNRICPLSL RSHPCPLGLKSPLRSQ ANALHLRSCPCSLPLG NHPYLPCLESQPCLSL GNHLCPLCPRSCRCPH LGSHPCRLS* (SEQ ID NO: 336) | ALHLRSCPC (B08.01) (SEQ ID NO: 926) CLHHRRHLV (B08.01) (SEQ ID NO: 927) CLHHRRHLVC (SEQ ID NO: 928) CLHRKSHPHL (B08.01) (SEQ ID NO: 929) CLRSHACPP (B08.01) (SEQ ID NO: 930) CLRSHTCPP (B08.01) (SEQ ID NO: 931) CLWCHACLH (A03.01) (SEQ ID NO: 932) CPHHLKNHL (B07.02) (SEQ ID NO: 933) CPHHLKNLL (B07.02) (SEQ ID NO: 934) CPHHLRTRL (B07.02, B08.01) (SEQ ID NO: 935) CPLHLRSLPF (B07.02, B08.01) (SEQ ID NO: 936) CPLPRHLKHL (B07.02, B08.01) (SEQ ID NO: 937) CPLSLRSHPC (B07.02) (SEQ ID NO: 938) CPRHLRNCPL (B07.02, B08.01) (SEQ ID NO: 939) FPHHLRHHA (B07.02, B08.01) (SEQ ID NO: 940) FPHHLRHHAC (B07.02, B08.01) (SEQ ID NO: 941) GLRSRTCPP (B08.01) (SEQ ID NO: 942) HACLHRLRNL (B08.01) (SEQ ID NO: 943) HLACLHHLR (A03.01) (SEQ ID NO: 944) HLCPPHLRY (A03.01) (SEQ ID NO: 945) HLCPPHLRYR (A03.01) (SEQ ID NO: 946) HLKHLACLH (A03.01) (SEQ ID NO: 947) HLKHRPCPH (B08.01) (SEQ ID NO: 948) HLKNHLCPP (B08.01) (SEQ ID NO: 949) HLKSHPCLH (A03.01) (SEQ ID NO: 950) HLKSLLCPL (A02.01, B08.01) (SEQ ID NO: 951) HLLHLRRLY (A03.01) (SEQ ID NO: 952) HLRNCPLPR (A03.01) (SEQ ID NO: 953) HLRNCPLPRH (A03.01) (SEQ ID NO: 954) HLRRLYPHHL (B08.01) (SEQ ID NO: 955) HLRSHPCPL (B07.02, B08.01) (SEQ ID NO: 956) HLRSHPCPLH (A03.01) (SEQ ID NO: 957) HLRSLPFPH (A03.01) (SEQ ID NO: 958) HLRTRLCPH (A03.01, B08.01) (SEQ ID NO: 959) HLVCSHHLK (A03.01) (SEQ ID NO: 960) HPCLHHRRHL (B07.02, B08.01) (SEQ ID NO: 961) | STAD, BLCA, CRC, HNSC, BRCA |

TABLE 1-continued

| | | | | |
|---|---|---|---|---|
| | | | HPGLRSRTC (B07.02) (SEQ ID NO: 962)<br>HPHLLHLRRL (B07.02, B08.01) (SEQ ID NO: 963)<br>HRKSHPHLL (B08.01) (SEQ ID NO: 964)<br>HRRTRSCPC (B08.01) (SEQ ID NO: 965)<br>KSHPHLLHLR (A03.01) (SEQ ID NO: 966)<br>KSLLCPLHLR (A03.01) (SEQ ID NO: 967)<br>LLCPLHLRSL (A02.01, B08.01) (SEQ ID NO: 968)<br>LLHLRRLYPH (B08.01) (SEQ ID NO: 969)<br>LPRHLKHLA (B07.02) (SEQ ID NO: 970)<br>LPRHLKHLAC (B07.02, B08.01) (SEQ ID NO: 971)<br>LRRLRSHTC (B08.01) (SEQ ID NO: 972)<br>LRRLYPHHL (B08.01) (SEQ ID NO: 973)<br>LVCSHHLKSL (B08.01) (SEQ ID NO: 974)<br>NLRNHTCPPS (B08.01) (SEQ ID NO: 975)<br>PLHLRSLPF (B08.01) (SEQ ID NO: 976)<br>RLCPHHLKNH (A03.01) (SEQ ID NO: 977)<br>RLYPHHLKH (A03.01) (SEQ ID NO: 978)<br>RLYPHHLKHR (A03.01) (SEQ ID NO: 979)<br>RPCPHHLKNL (B07.02) (SEQ ID NO: 980)<br>RSHPCPLHLK (A03.01) (SEQ ID NO: 981)<br>RSLPFPHHLR (A03.01) (SEQ ID NO: 982)<br>RTRLCPHHL (B07.02) (SEQ ID NO: 983)<br>RTRLCPHHLK (A03.01) (SEQ ID NO: 984)<br>SLLCPLHLR (A03.01) (SEQ ID NO: 985)<br>SLRSHACPP (B08.01) (SEQ ID NO: 986)<br>SPLRSQANA (B07.02) (SEQ ID NO: 987)<br>YLRRLRSHT (B08.01) (SEQ ID NO: 988)<br>YPHHLKHRPC (B07.02, B08.01) (SEQ ID NO: 989) | |
| PTEN | I122fs<br>I135fs<br>A148fs<br>L152fs<br>D162fs<br>I168fs | SWKGTNWCNDMCIFI<br>TSGQIFKGTRGPRFLW<br>GSKDQRQKGSNYSQS<br>EALCVLL* (SEQ ID NO: 337) | FITSGQIFK (A03.01) (SEQ ID NO: 990)<br>IFITSGQIF (A24.02) (SEQ ID NO: 991)<br>SQSEALCVL (A02.01) (SEQ ID NO: 992)<br>SQSEALCVLL (A02.01) (SEQ ID NO: 993) | UCEC, PRAD, SKCM, STAD, BRCA, LUSC, KIRC, LIHC, KIRP, GBM |
| PTEN | L265fs<br>K266fs | KRTKCFTFG* (SEQ ID NO: 338) | | UCEC, PRAD, SKCM, STAD, BRCA, LUSC, KIRC, LIHC, KIRP, GBM |
| PTEN | A39fs<br>E40fs<br>V45fs<br>R47fs<br>N48fs | PIFIQTLLLWDFLQKD<br>LKAYTGTILMM* (SEQ ID NO: 339) | AYTGTILMM (A24.02) (SEQ ID NO: 994)<br>DLKAYTGTIL (B08.01) (SEQ ID NO: 995) | UCEC, PRAD, SKCM, STAD, BRCA, LUSC, KIRC, LIHC, KIRP, GBM |

TABLE 1-continued

| PTEN | T319fs<br>T321fs<br>K327fs<br>A328fs<br>A333fs | QKMILTKQIKTKPTDT<br>FLQILR* (SEQ ID NO:<br>340) | ILTKQIKTK (A03.01) (SEQ<br>ID NO: 996)<br>KMILTKQIK (A03.01) (SEQ<br>ID NO: 997)<br>KPTDTFLQI (B07.02) (SEQ<br>ID NO: 998)<br>KPTDTFLQIL (B07.02) (SEQ<br>ID NO: 999)<br>MILTKQIKTK (A03.01) (SEQ<br>ID NO: 1000) | UCEC, PRAD, SKCM,<br>STAD, BRCA, LUSC,<br>KIRC, LIHC, KIRP,<br>GBM |
| --- | --- | --- | --- | --- |
| PTEN | N63fs<br>E73fs<br>A86fs<br>N94fs | GFWIQSIKTITRYTIFV<br>LKDIMTPPNLIAELHNI<br>LLKTITHHS* (SEQ ID<br>NO: 341) | ITRYTIFVLK (A03.01) (SEQ<br>ID NO: 1001)<br>LIAELHNIL (A02.01) (SEQ<br>ID NO: 1002)<br>LIAELHNILL (A02.01) (SEQ<br>ID NO: 1003)<br>MTPPNLIAEL (A02.01) (SEQ<br>ID NO: 1004)<br>NLIAELHNI (A02.01) (SEQ<br>ID NO: 1005)<br>NLIAELHNIL (A02.01) (SEQ<br>ID NO: 1006)<br>RYTIFVLKDI (A24.02) (SEQ<br>ID NO: 1007)<br>TITRYTIFVL (A02.01) (SEQ<br>ID NO: 1008)<br>TPPNLIAEL (B07.02) (SEQ<br>ID NO: 1009) | UCEC, PRAD, SKCM,<br>STAD, BRCA, LUSC,<br><br>KIRC, LIHC, KIRP,<br><br><br><br><br><br>GBM |
| PTEN | T202fs<br>G209fs<br>C211fs<br>I224fs<br>G230fs<br>P231fs<br>R233fs<br>D236fs | NYSNVQWRNLQSSVC<br>GLPAKGEDIFLQFRTH<br>TTGRQVHVL* (SEQ ID<br>NO: 342) | FLQFRTHTT (A02.01,<br>B08.01) (SEQ ID NO: 1010)<br>LPAKGEDIFL (B07.02) (SEQ<br>ID NO: 1011)<br>LQFRTHTTGR (A03.01) (SEQ<br>ID NO: 1012)<br>NLQSSVCGL (A02.01) (SEQ<br>ID NO: 1013)<br>SSVCGLPAK (A03.01) (SEQ<br>ID NO: 1014)<br>VQWRNLQSSV (A02.01)<br>(SEQ ID NO: 1015) | UCEC, PRAD, SKCM,<br>STAD, BRCA, LUSC,<br>KIRC, LIHC, KIRP,<br>GBM |
| PTEN | G251fs<br>E256fs<br>K260fs<br>Q261fs<br>L265fs<br>M270fs<br>H272fs<br>T286fs<br>E288fs | YQSRVLPQTEQDAKK<br>GQNVSLLGKYILHTRT<br>RGNLRKSRKWKSM*<br>(SEQ ID NO: 343) | GQNVSLLGK (A03.01) (SEQ<br>ID NO: 1016)<br>HTRTRGNLRK (A03.01)<br>(SEQ ID NO: 1017)<br>ILHTRTRGNL (B08.01) (SEQ<br>ID NO: 1018)<br>KGQNVSLLGK (A03.01)<br>(SEQ ID NO: 1019)<br>LLGKYILHT (A02.01) (SEQ<br>ID NO: 1020)<br>LRKSRKWKSM (B08.01)<br>(SEQ ID NO: 1021)<br>SLLGKYILH (A03.01) (SEQ<br>ID NO: 1022)<br>SLLGKYILHT (A02.01) (SEQ<br>ID NO: 1023) | UCEC, PRAD, SKCM,<br>STAD, BRCA, LUSC,<br>KIRC, LIHC, KIRP,<br>GBM |
| TP53 | A70fs<br>P72fs<br>A76fs<br>A79fs<br>P89fs<br>W91fs<br>S96fs<br>V97fs<br>V97fs<br>G108fs<br>G117fs<br>S121fs<br>V122fs<br>C124fs<br>K139fs<br>V143fs | SSQNARGCSPRGPCTS<br>SSYTGGPCTSPLLAPVI<br>FCPFPENLPGQLRFPS<br>GLLAFWDSQVCDLHV<br>LPCPQQDVLPTGQDLP<br>CAAVG* (SEQ ID NO:<br>344) | CTSPLLAPV (A02.01) (SEQ<br>ID NO: 1024)<br>FPENLPGQL (B07.02) (SEQ<br>ID NO: 1025)<br>GLLAFWDSQV (A02.01)<br>(SEQ ID NO: 1026)<br>IFCPFPENL (A24.02) (SEQ ID<br>NO: 1027)<br>LLAFWDSQV (A02.01) (SEQ<br>ID NO: 1028)<br>LLAPVIFCP (A02.01) (SEQ<br>ID NO: 1029)<br>LLAPVIFCPF (A02.01,<br>A24.02) (SEQ ID NO: 1030)<br>LPCPQQDVL (B07.02) (SEQ<br>ID NO: 1031)<br>RFPSGLLAF (A24.02) (SEQ<br>ID NO: 1032)<br>RFPSGLLAFW (A24.02) (SEQ<br>ID NO: 1033) | BRCA, CRC, LUAD,<br>PRAD, HNSC, LUSC,<br>PAAD, STAD, BLCA,<br>OV, LIHC, SKCM,<br>UCEC, LAML, UCS,<br>KICH, GBM, ACC |

TABLE 1-continued

| | | | SPLLAPVIF (B07.02) (SEQ ID NO: 1034)<br>SPRGPCTSS (B07.02) (SEQ ID NO: 1035)<br>SPRGPCTSSS (B07.02) (SEQ ID NO: 1036)<br>SQVCDLHVL (A02.01) (SEQ ID NO: 1037)<br>VIFCPFPENL (A02.01) (SEQ ID NO: 1038) | |
|---|---|---|---|---|
| TP53 | V173fs<br>H178fs<br>D186fs<br>H193fs<br>L194fs<br>E198fs<br>V203fs<br>E204fs<br>L206fs<br>D207fs<br>N210fs<br>T211fs<br>F212fs<br>V225fs<br>S241fs | GAAPTMSAAQIAMV<br>WPLLSILSEWKEICVW<br>SIWMTETLFDIVWWC<br>PMSRLRLALTVPPSTT<br>TTCVTVPAWAA*<br>(SEQ ID NO: 345) | AMVWPLLSI (A02.01) (SEQ ID NO: 1039)<br>AMVWPLLSIL (A02.01) (SEQ ID NO: 1040)<br>AQIAMVWPL (A02.01, A24.02) (SEQ ID NO: 1041)<br>AQIAMVWPLL (A02.01) (SEQ ID NO: 1042)<br>CPMSRLRLA (B07.02, B08.01) (SEQ ID NO: 1043)<br>CPMSRLRLAL (B07.02, B08.01) (SEQ ID NO: 1044)<br>IAMVWPLLSI (A02.01, A24.02, B08.01) (SEQ ID NO: 1045)<br>ILSEWKEICV (A02.01) (SEQ ID NO: 1046)<br>IVWWCPMSR (A03.01) (SEQ ID NO: 1047)<br>IVWWCPMSRL (A02.01) (SEQ ID NO: 1048)<br>IWMTETLFDI (A24.02) (SEQ ID NO: 1049)<br>LLSILSEWK (A03.01) (SEQ ID NO: 1050)<br>MSAAQIAMV (A02.01) (SEQ ID NO: 1051)<br>MSRLRLALT (B08.01) (SEQ ID NO: 1052)<br>MSRLRLALTV (B08.01) (SEQ ID NO: 1053)<br>MVWPLLSIL (A02.01) (SEQ ID NO: 1054)<br>RLALTVPPST (A02.01) (SEQ ID NO: 1055)<br>TLFDIVWWC (A02.01) (SEQ ID NO: 1056)<br>TLFDIVWWCP (A02.01) (SEQ ID NO: 1057)<br>TMSAAQIAMV (A02.01) (SEQ ID NO: 1058)<br>VWSIWMTETL (A24.02) (SEQ ID NO: 1059)<br>WMTETLFDI (A02.01, A24.02) (SEQ ID NO: 1060)<br>WMTETLFDIV (A01.01, A02.01) (SEQ ID NO: 1061) | BRCA, CRC, LUAD, PRAD, HNSC, LUSC, PAAD, STAD, BLCA, OV, LIHC, SKCM, UCEC, LAML, UCS, KICH, GBM, ACC |
| TP53 | R248fs<br>P250fs<br>S260fs<br>N263fs<br>G266fs<br>N268fs<br>V272fs<br>V274fs<br>P278fs<br>D281fs<br>R282fs<br>T284fs<br>E285fs<br>L289fs<br>K292fs<br>P301fs<br>S303fs<br>T312fs<br>S314fs<br>K319fs | TGGPSSPSSHWKTPVV<br>IYWDGTALRCVFVPV<br>LGETGAQRKRISARK<br>GSLTTSCPQGALSEHC<br>PTTPAPLPSQRRNHW<br>MENISPFRSVGVSASR<br>CSES* (SEQ ID NO: 346) | ALRCVFVPV (A02.01, B08.01) (SEQ ID NO: 1062)<br>ALRCVFVPVL (A02.01, B08.01) (SEQ ID NO: 1063)<br>ALSEHCPTT (A02.01) (SEQ ID NO: 1064)<br>AQRKRISARK (A03.01) (SEQ ID NO: 1065)<br>GAQRKRISA (B08.01) (SEQ ID NO: 1066)<br>HWMENISPF (A24.02) (SEQ ID NO: 1067)<br>LPSQRRNHW (B07.02) (SEQ ID NO: 1068)<br>LPSQRRNHWM (B07.02, B08.01) (SEQ ID NO: 1069)<br>NISPFRSVGV (A02.01) (SEQ ID NO: 1070)<br>RISARKGSL (B07.02, B08.01) (SEQ ID NO: 1071) | BRCA, CRC, LUAD, PRAD, HNSC, LUSC, PAAD, STAD, BLCA, OV, LIHC, SKCM, UCEC, LAML, UCS, KICH, GBM, ACC |

TABLE 1-continued

| | | | | |
|---|---|---|---|---|
| | K320fs<br>P322fs<br>Y327fs<br>F328fs<br>L330fs<br>R333fs<br>R335fs<br>R337fs<br>E339fs | | SPFRSVGVSA (B07.02) (SEQ ID NO: 1072)<br>SPSSHWKTPV (B07.02, B08.01) (SEQ ID NO: 1073)<br>TALRCVFVPV (A02.01) (SEQ ID NO: 1074)<br>VIYWDGTAL (A02.01) (SEQ ID NO: 1075)<br>VIYWDGTALR (A03.01) (SEQ ID NO: 1076)<br>VLGETGAQRK (A03.01) (SEQ ID NO: 1077) | |
| TP53 | S149fs<br>P151fs<br>P152fs<br>V157fs<br>Q165fs<br>S166fs<br>H168fs<br>V173fs | FHTPARHPRPRHGHL<br>QAVTAHDGGCEALPP<br>P* (SEQ ID NO: 347) | HPRPRHGHL (B07.02, B08.01) (SEQ ID NO: 1078)<br>HPRPRHGHLQ (B07.02) (SEQ ID NO: 1079)<br>RPRHGHLQA (B07.02) (SEQ ID NO: 1080)<br>RPRHGHLQAV (B07.02, B08.01) (SEQ ID NO: 1081) | BRCA, CRC, LUAD, PRAD, HNSC, LUSC, PAAD, STAD, BLCA, OV, LIHC, SKCM, UCEC, LAML, UCS, KICH, GBM, ACC |
| TP53 | P47fs<br>D48fs<br>D49fs<br>Q52fs<br>F54fs<br>E56fs<br>P58fs<br>P60fs<br>E62fs<br>M66fs<br>P72fs<br>V73fs<br>P75fs<br>A78fs<br>P82fs<br>P85fs<br>S96fs<br>P98fs<br>T102fs<br>Y103fs<br>G108fs<br>F109fs<br>R110fs<br>G117fs | CCPRTILNNGSLKTQV<br>QMKLPECORLLPPWP<br>LHQQLLHRRPLHQPPP<br>GPCHLLSLPRKPTRAA<br>TVSVWASCILGQPSL*<br>(SEQ ID NO: 348) | GSLKTQVQMK (A03.01) (SEQ ID NO: 1082)<br>PPGPCHLLSL (B07.02) (SEQ ID NO: 1083)<br>RTILNNGSLK (A03.01) (SEQ ID NO: 1084)<br>SLKTQVQMK (A03.01) (SEQ ID NO: 1085)<br>SLKTQVQMKL (B08.01) (SEQ ID NO: 1086)<br>TILNNGSLK (A03.01) (SEQ ID NO: 1087) | BRCA, CRC, LUAD, PRAD, HNSC, LUSC, PAAD, STAD, BLCA, OV, LIHC, SKCM, UCEC, LAML, UCS, KICH, GBM, ACC |
| TP53 | L26fs<br>P27fs<br>P34fs<br>P36fs<br>A39fs<br>Q38fs | VRKHFQTYGNYFLKT<br>TFCPPCRPKQWMI*<br>(SEQ ID NO: 349) | CPPCRPKQWM (B07.02) (SEQ ID NO: 1088)<br>TTFCPPCRPK (A03.01) (SEQ ID NO: 1089) | BRCA, CRC, LUAD, PRAD, HNSC, LUSC, PAAD, STAD, BLCA, OV, LIHC, SKCM, UCEC, LAML, UCS, KICH, GBM, ACC |
| TP53 | C124fs<br>L130fs<br>N131fs<br>C135fs<br>K139fs<br>A138fs<br>T140fs<br>V143fs<br>Q144fs<br>V147fs<br>T150fs<br>P151fs<br>P152fs<br>G154fs<br>R156fs<br>R158fs<br>A161fs | LARTPLPSTRCFANWP<br>RPALCSCGLIPHPRPAP<br>ASAPWPSTSSHST*<br>(SEQ ID NO: 350) | CFANWPRPAL (A24.02) (SEQ ID NO: 1090)<br>FANWPRPAL (B07.02, B08.01) (SEQ ID NO: 1091)<br>GLIPHPRPA (A02.01) (SEQ ID NO: 1092)<br>HPRPAPASA (B07.02, B08.01) (SEQ ID NO: 1093)<br>HPRPAPASAP (B07.02) (SEQ ID NO: 1094)<br>IPHPRPAPA (B07.02, B08.01) (SEQ ID NO: 1095)<br>IPHPRPAPAS (B07.02) (SEQ ID NO: 1096)<br>RPALCSCGL (B07.02) (SEQ ID NO: 1097)<br>RPALCSCGLI (B07.02) (SEQ ID NO: 1098)<br>TPLPSTRCF (B07.02) (SEQ ID NO: 1099)<br>WPRPALCSC (B07.02) (SEQ ID NO: 1100)<br>WPRPALCSCG (B07.02) (SEQ ID NO: 1101) | BRCA, CRC, LUAD, PRAD, HNSC, LUSC, PAAD, STAD, BLCA, OV, LIHC, SKCM, UCEC, LAML, UCS, KICH, GBM, ACC |

TABLE 1-continued

| | | | | |
|---|---|---|---|---|
| VHL | L178fs<br>D179fs<br>L184fs<br>T202fs<br>R205fs<br>D213fs<br>G212fs | ELQETGHRQVALRRS<br>GRPPKCAERPGAADT<br>GAHCTSTDGRLKISVE<br>TYTVSSQLLMVLMSL<br>DLDTGLVPSLVSKCLI<br>LRVK* (SEQ ID NO:<br>351) | ALRRSGRPPK (A03.01) (SEQ<br>ID NO: 1102)<br>GLVPSLVSK (A03.01) (SEQ<br>ID NO: 1103)<br>KISVETYTV (A02.01) (SEQ<br>ID NO: 1104)<br>LLMVLMSLDL (A02.01,<br>B08.01) (SEQ ID NO: 1105)<br>LMSLDLDTGL (A02.01)<br>(SEQ ID NO: 1106)<br>LMVLMSLDL (A02.01) (SEQ<br>ID NO: 1107)<br>LVSKCLILRV (A02.01) (SEQ<br>ID NO: 1108)<br>QLLMVLMSL (A02.01,<br>B08.01) (SEQ ID NO: 1109)<br>RPGAADTGA (B07.02) (SEQ<br>ID NO: 1110)<br>RPGAADTGAH (B07.02)<br>(SEQ ID NO: 1111)<br>SLDLDTGLV (A02.01) (SEQ<br>ID NO: 1112)<br>SLVSKCLIL (A02.01, B08.01)<br>(SEQ ID NO: 1113)<br>SQLLMVLMSL (A02.01)<br>(SEQ ID NO: 1114)<br>TVSSQLLMV (A02.01) (SEQ<br>ID NO: 1115)<br>TYTVSSQLL (A24.02) (SEQ<br>ID NO: 1116)<br>TYTVSSQLLM (A24.02)<br>(SEQ ID NO: 1117)<br>VLMSLDLDT (A02.01) (SEQ<br>ID NO: 1118)<br>VPSLVSKCL (B07.02) (SEQ<br>ID NO: 1119)<br>VSKCLILRVK (A03.01) (SEQ<br>ID NO: 1120)<br>YTVSSQLLM (A01.01) (SEQ<br>ID NO: 1121)<br>YTVSSQLLMV (A02.01)<br>(SEQ ID NO: 1122) | KIRC, KIRP |
| VHL | L158fs<br>K159fs<br>R161fs<br>Q164fs | KSDASRLSGA* (SEQ<br>ID NO: 352) | | KIRC, KIRP |
| VHL | P146fs<br>I147fs<br>F148fs<br>L158fs | RTAYFCQYHTASVYS<br>ERAMPPGCPEPSQA*<br>(SEQ ID NO: 353) | FCQYHTASV (B08.01) (SEQ<br>ID NO: 1123) | KIRC, KIRP |
| VHL | S68fs<br>S72fs<br>I75fs<br>S80fs<br>P86fs<br>P97fs<br>I109fs<br>H115fs<br>L116fs<br>G123fs<br>T124fs<br>N131fs<br>L135fs<br>V137fs<br>G144fs<br>D143fs<br>I147fs | TRASPPRSSSAIAVRAS<br>CCPYGSTSTASRSPTQ<br>RCRLARAAASTATEV<br>TFGSSEMQGHTMGFW<br>LTKLNYLCHLSMLTD<br>SLFLPISHCQCIL*<br>(SEQ ID NO: 354) | CPYGSTSTA (B07.02) (SEQ<br>ID NO: 1124)<br>CPYGSTSTAS (B07.02) (SEQ<br>ID NO: 1125)<br>LARAAASTAT (B07.02)<br>(SEQ ID NO: 1126)<br>MLTDSLFLP (A02.01) (SEQ<br>ID NO: 1127)<br>PPRSSSAIAV (B07.02) (SEQ<br>ID NO: 1128)<br>RAAASTATEV (B07.02)<br>(SEQ ID NO: 1129)<br>SPPRSSSAI (B07.02) (SEQ ID<br>NO: 1130)<br>SPPRSSSAIA (B07.02) (SEQ<br>ID NO: 1131)<br>SPTQRCRLA (B07.02) (SEQ<br>ID NO: 1132)<br>TQRCRLARA (B08.01) (SEQ<br>ID NO: 1133)<br>TQRCRLARAA (B08.01)<br>(SEQ ID NO: 1134) | KIRC, KIRP |

TABLE 1-continued

| | | | | |
|---|---|---|---|---|
| VHL | K171fs<br>P172fs<br>N174fs<br>L178fs<br>D179fs<br>L188fs | SSLRITGDWTSSGRST<br>KIWKTTQMCRKTWSG<u>*</u> (SEQ ID NO: 355) | KIWKTTQMCR (A03.01) (SEQ ID NO: 1135)<br>WTSSGRSTK (A03.01) (SEQ ID NO: 1136) | KIRC, KIRP |
| VHL | V62fs<br>V66fs<br>Q73fs<br>V84fs<br>F91fs<br>T100fs<br>P103fs<br>S111fs<br>L116fs<br>H115fs<br>D126fs | RRRGGVGRRGVRPG<br>RVRPGGTGRRGGDGG<br>RAAAARAALGELARA<br>LPGHLLQSQSARRAA<br>RMAQLRRRAAALPNA<br>AAWHGPPHPQLPRSP<br>LALQRCRDTRWASG* (SEQ ID NO: 356) | ALGELARAL (A02.01) (SEQ ID NO: 1137)<br>AQLRRRAAA (B08.01) (SEQ ID NO: 1138)<br>AQLRRRAAAL (B08.01) (SEQ ID NO: 1139)<br>ARRAARMAQL (B08.01) (SEQ ID NO: 1140)<br>HPQLPRSPL (B07.02, B08.01) (SEQ ID NO: 1141)<br>HPQLPRSPLA (B07.02) (SEQ ID NO: 1142)<br>LARALPGHL (B07.02) (SEQ ID NO: 1143)<br>LARALPGHLL (B07.02) (SEQ ID NO: 1144)<br>MAQLRRRAA (B07.02, B08.01) (SEQ ID NO: 1145)<br>MAQLRRRAAA (B07.02, B08.01) (SEQ ID NO: 1146)<br>QLRRRAAAL (B07.02, B08.01) (SEQ ID NO: 1147)<br>RAAALPNAAA (B07.02) (SEQ ID NO: 1148)<br>RMAQLRRRAA (B07.02, B08.01) (SEQ ID NO: 1149)<br>SQSARRAARM (B08.01) (SEQ ID NO: 1150) | KIRC, KIRP |
| TABLE 1D | | CRYPTIC EXON [1] | | |
| AR-v7 | cryptic final exon | SCKVFFKRAAEGKQK<br>YLCASRNDCTIDKFRR<br>KNCPSCRLRKCYEAG<br>MTLGEKFRVGNCKHL<br>KMTRP* (SEQ ID NO: 357) | GMTLGEKFRV (A02:01) (SEQ ID NO: 1151)<br>RVGNCKHLK (A03.01) (SEQ ID NO: 1152) | Prostate Cancer, Castration-resistant Prostate Cancer |
| TABLE 1E | | OUT OF FRAME FUSIONS [1,3] | | |
| AC011997.1:LRRC69 | AC011997.1:LRRC69 *out-of-frame | MAGAPPPASLPPCSLIS<br>DCCASNQRDSVGVGP<br>SEP:G:NNIKICNESAS<br>RK* (SEQ ID NO: 358) | GPSEPGNNI (B07.02) (SEQ ID NO: 1153)<br>KICNESASRK (A03.01) (SEQ ID NO: 1154) | LUSC, Breast Cancer, Head and Neck Cancer, LUAD |
| EEF1DP3 | EEF1DP3:FRY *out-of-frame | HGWRPFLPVRARSRW<br>NRRLDVTVANGR:S:W<br>KYGWSLLRVPQVNG<br>IQVLNVSLKSSSNVIS<br>YE* (SEQ ID NO: 359) | GIQVLNVSLK (A03.01) (SEQ ID NO: 1155)<br>IQVLNVSLK (A03.01) (SEQ ID NO: 1156)<br>KSSSNVISY (A01.01, A03.01) (SEQ ID NO: 1157)<br>KYGWSLLRV (A24.02) (SEQ ID NO: 1158)<br>RSWKYGWSL (A02.01) (SEQ ID NO: 1159)<br>SLKSSSNVI (B08.01) (SEQ ID NO: 1160)<br>SWKYGWSLL (A24.02) (SEQ ID NO: 1161)<br>TVANGRSWK (A03.01) (SEQ ID NO: 1162)<br>VPQVNGIQV (B07.02) (SEQ ID NO: 1163)<br>VPQVNGIQVL (B07.02) (SEQ ID NO: 1164)<br>VTVANGRSWK (A03.01) (SEQ ID NO: 1165)<br>WSLLRVPQV (B08.01) (SEQ ID NO: 1166) | Breast Cancer |

TABLE 1-continued

| | | | | |
|---|---|---|---|---|
| MAD1L1:MAFK | MAD1L1:MAFK | RLKEVFQTKIQEFRKA CYTLTGYQIDITTENQ YRLTSLYAEHPGDCLI FK::LRVPGSSVLVTV PGL* (SEQ ID NO: 360) | HPGDCLIFKL (B07.02) (SEQ ID NO: 1167) KLRVPGSSV (B07.02) (SEQ ID NO: 1168) KLRVPGSSVL (B07.02) (SEQ ID NO: 1169) RVPGSSVLV (A02.01) (SEQ ID NO: 1170) SVLVTVPGL (A02.01) (SEQ ID NO: 1171) VPGSSVLVTV (B07.02) (SEQ ID NO: 1172) | CLL |
| PPP1R1B:STARD3 | PPP1R1B:STARD3 | AEVLKVIRQSAGQKT TCGQGLEGPWERPPPL DESERDGGSEDQVED PALS:A:LLLRPRPPRP EVGAHQDEQAAQGA DPRLGAQPACRGLP GLLTVPQPEPLLAPP SAA* (SEQ ID NO: 361) | ALLLRPRPPR (A03.01) (SEQ ID NO: 1173) ALSALLLRPR (A03.01) (SEQ ID NO: 1174) | Breast Cancer |
| Table 1F | | IN FRAME DELETIONS and FUSIONS [1,2] | | |
| BCR:ABL | BCR:ABL | ERAEWRENIREQQKK CFRSFSLTSVELQMLT NSCVKLQTVHSIPLTI NKE::EALQRPVASDF EPQGLSEAARWNSK ENLLAGPSENDPNLF VALYDFVASG (SEQ ID NO: 362) | LTINKEEAL (A02.01, B08.01) (SEQ ID NO: 1175) | CML, AML |
| BCR:ABL | BCR:ABL | ELQMLTNSCVKLQTV HSIPLTINKEDDESPGL YGFLNVIVHSATGFKQ SS:K:ALQRPVASDFE PQGLSEAARWNSKE NLLAGPSENDPNLFV ALYDFVASGD (SEQ ID NO: 363) | IVHSATGFK (A03.01) (SEQ ID NO: 1176) ATGFKQSSK (A03.01) (SEQ ID NO: 1177) | CML, AML |
| C11orf95:RELA | C11orf95:RELA | ISNSWDAHLGLGACG EAEGLGVQGAEEEEE EEEEEEEGAGVPACP PKGP:E:LFPLIFPAEP AQASGPYVEIIEQPK QRGMRFRYKCEGRS AGSIPGERSTD (SEQ ID NO: 364) | ELFPLIFPA (A02.01, B08.01) (SEQ ID NO: 1178) KGPELFPLI (A02.01, A24.02) (SEQ ID NO: 1179) KGPELFPLIF (A24.02) (SEQ ID NO: 1180) | Supretentorial ependyomas |
| CBFB:MYH11 | (variant "type a") | LQRLDGMGCLEFDEE RAQQEDALAQQAFEE ARRRTREFEDRDRSH REEME::VHELEKSKR ALETQMEEMKTQLE ELEDELQATEDAKL RLEVNMQALKGQF (SEQ ID NO: 365) | | AML |
| CD74:ROS1 | (exon6:exon32) | KGSFPENLRHLKNTM ETIDWKVFESWMHH WLLFEMSRHSLEQKP TDAPPK::AGVPNKPG IPKLLEGSKNSIQWE KAEDNGCRITYYILEI RKSTSNNLQNQ (SEQ ID NO: 366) | KPTDAPPKAGV (B07.02) (SEQ ID NO: 1181) | NSCLC, Crizotinib resistance |
| EGFR | EGFRvIII (internal deletion) | MRPSGTAGAALLALL AALCPASRALEEKK:G: NYVVTDHGSCVRAC GADSYEMEEDGVRKC KKCEGPCRKVCNGIGI GEFKD (SEQ ID NO: 367) | ALEEKKGNYV (A02.01) (SEQ ID NO: 1182) | GBM |

TABLE 1-continued

| | | | | |
|---|---|---|---|---|
| EGFR: SEPT14 | EGFR:SEPT14 | LPQPPICTIDVYMIMV KCWMIDADSRPKFRE LIIEFSKMARDPQRYL VIQ::LQDKFEHLKMI QQEEIRKLEEEKKQL EGEIIDFYKMKAASE ALQTQLSTD (SEQ ID NO: 368) | IQLQDKFEHL (A02.01, B08.01) (SEQ ID NO: 1183) QLQDKFEHL (A02.01, B08.01) (SEQ ID NO: 1184) QLQDKFEHLK (A03.01) (SEQ ID NO: 1185) YLVIQLQDKF (A02.01, A24.02) (SEQ ID NO: 1186) | GBM, Glioma, Head and Neck Cancer |
| EML4:ALK | EML4:ALK | SWENSDDSRNKLSKIP STPKLIPKVTKTADKH KDVIINQAKMSTREK NSQ:V:YRRKHQELQ AMQMELQSPEYKLS KLRTSTIMTDYNPNY CFAGKTSSISDL (SEQ ID NO: 369) | QVYRRKHQEL (B08.01) (SEQ ID NO: 1187) STREKNSQV (B08.01) (SEQ ID NO: 1188) VYRRKHQEL (A24.02, B08.01) (SEQ ID NO: 1189) | NSCLC |
| FGFR3: TACC3 | FGFR3:TACC3 | EGHRMDKPANCTHDL YMIMRECWHAAPSQR PTFKQLVEDLDRVLT VTSTD::VKATQEENR ELRSRCEELHGKNLE LGKIMDRFEEVVYQ AMEEVQKQKELS (SEQ ID NO: 370) | VLTVTSTDV (A02.01) (SEQ ID NO: 1190) VLTVTSTDVK (A03.01) (SEQ ID NO: 1191) | Bladder Cancer, LUSC |
| NAB:STAT6 | NAB:STAT6 "" | RDNTLLLRRVELFSLS RQVARESTYLSSLKGS RLHPEELGGPPLKKLK QE::ATSKSQIMSLWG LVSKMPPEKVQRLY VDFPQHLRHLLGDW LESQPWEFLVGSDAF CC (SEQ ID NO: 371) | IMSLWGLVS (A02.01) (SEQ ID NO: 1192) IMSLWGLVSK (A03.01) (SEQ ID NO: 1193) KLKQEATSK (A03.01) (SEQ ID NO: 1194) QIMSLWGLV (A02.01) (SEQ ID NO: 1195) SQIMSLWGL (A02.01, A24.02, B08.01) (SEQ ID NO: 1196) SQIMSLWGLV (A02.01) (SEQ ID NO: 1197) TSKSQIMSL (B08.01) (SEQ ID NO: 1198) | Solitary fibrous tumors |
| NDRG1:ERG | NDRG1:ERG | MSREMQDVDLAEVKP LVEKGETITGLLQEFD VQ::EALSVVSEDQSL FECAYGTPHLAKTE MTASSSSDYGQTSK MSPRVPQQDW (SEQ ID NO: 372) | LLQEFDVQEA (A02.01) (SEQ ID NO: 1199) LQEFDVQEAL (A02.01) (SEQ ID NO: 1200) | Prostate Cancer |
| PML:RARA | PML:RARA (exon3:exon3) | VLDMHGFLRQALCRL RQEEPQSLQAAVRTD GFDEFKVRLQDLSSCI TQGK:A:IETQSSSSEE IVPSPPSPPPLPRIYKP CFVCQDKSSGYHYG VSACEGCKG (SEQ ID NO: 373) | | Acute promyelocytic leukemia |
| PML:RARA | PML:RARA (exon6:exon3) | RSSPEQPRPSTSKAVSP PHLDGPPSPRSPVIGSE VFLPNSNHVASGAGE A:A:IETQSSSSEEIVPS PPSPPPLPRIYKPCFV CQDKSSGYHYGVSA CEGCKG (SEQ ID NO: 374) | | Acute promyelocytic leukemia |
| RUNX1 | RUNX1(ex5)- RUNXIT1(ex2) | VARFNDLRFVGRSGR GKSFTLTITVFTNPPQ VATYHRAIKITVDGPR EPR:N:RTEKHSTMPD SPVDVKTQSRLTPPT MPPPPTTQGAPRTSS FTPTTLTNGT (SEQ ID NO: 375) | GPREPRNRT (B07.02) (SEQ ID NO: 1201) RNRTEKHSTM (B08.01) (SEQ ID NO: 1202) | AML |

TABLE 1-continued

| | | | | |
|---|---|---|---|---|
| TMPRSS2: ERG | TMPRSS2:ERG | MALNS::EALSVVSED QSLFECAYGTPHLAKT EMTASSSSDYGQTSK MSPRVPQQDW (SEQ ID NO: 376) | ALNSEALSV (A02.01) (SEQ ID NO: 1203) ALNSEALSVV (A02.01) (SEQ ID NO: 1204) MALNSEALSV (A02.01, B08.01) (SEQ ID NO: 1205) | Prostate Cancer |

[1] Underlined AAs represent non-native AAs
[2] Bolded AAs represent native AAs of the amino acid sequence encoded by the second of the two fused genes
[3] Bolded and underlined AAs represent non-native AAs of the amino acid sequence encoded by the second of the two fused genes due to a frameshift.

TABLE 2

| Gene | Exemplary Protein Change | Mutation Sequence Context | Peptides (HLA allele example(s)) | Exemplary Diseases |
|---|---|---|---|---|
| Table 2A | | POINT MUTATIONS[1] | | |
| AKT1 | E17K | MSDVAIVKEGWLHKR GKYIKTWRPRYFLLK NDGTFIGYKERPQDV DQREAPLNNFSVAQC QLMKTER (SEQ ID NO: 1206) | KYIKTWRPRY (A24.02) (SEQ ID NO: 1248) WLHKRGKYI (A02.01, B07.02, B08.01) (SEQ ID NO: 1249) WLHKRGKYIK (A03.01) (SEQ ID NO: 1250) | BRCA, CESC, HNSC, LUSC, PRAD, SKCM, THCA |
| ANAPC1 | T537A | TMLVLEGSGNLVLYT GVVRVGKVFIPGLPAP SLTMSNTMPRPSTPLD GVSAPKPLSKLLGSLD EVVLLSPVPELRDSSK LHDSLYNEDCTFQQL GTYIHSI (SEQ ID NO: 1207) | APKPLSKLL (B07.02) (SEQ ID NO: 1251) GVSAPKPLSK (A03.01) (SEQ ID NO: 1252) VSAPKPLSK (A03.01) (SEQ ID NO: 1253) | GBM, LUSC, PAAD, PRAD, SKCM |
| FGFR3 | S249C | HRIGGIKLRHQQWSL VMESVVPSDRGNYTC VVENKFGSIRQTYTLD VLERCPHRPILQAGLP ANQTAVLGSDVEFHC KVYSDAQPHIQWLKH VEVNGSKVG (SEQ ID NO: 1208) | CPHRPILQA (B07.02) (SEQ ID NO: 1254) | BLCA, HNSC, KIRP, LUSC |
| FRG1B | I10T | MREPIYMHSTMVFLP WELHTKKGPSPPEQF MAVKLSDSRTALKSG YGKYLGINSDELVGH SDAIGPREQWEPVFQ NGKMALLASNSCFIR (SEQ ID NO: 1209) | KLSDSRTAL (A02.01, B07.02, B08.01) (SEQ ID NO: 1255) KLSDSRTALK (A03.01) (SEQ ID NO: 1256) LSDSRTALK (A01.01, A03.01) (SEQ ID NO: 1257) RTALKSGYGK (A03.01) (SEQ ID NO: 1258) TALKSGYGK (A03.01) (SEQ ID NO: 1259) | KIRP, PRAD, SKCM |
| FRG1B | L52S | AVKLSDSRIALKSGYG KYLGINSDELVGHSD AIGPREQWEPVFQNG KMALSASNSCFIRCNE AGDIEAKSKTAGEEE MIKIRSCAEKETKKKD DIPEEDKG (SEQ ID NO: 1210) | ALSASNSCF (A02.01, A24.02, B07.02) (SEQ ID NO: 1260) ALSASNSCFI (A02.01) (SEQ ID NO: 1261) FQNGKMALSA (A02.01, B08.01) (SEQ ID NO: 1262) | GBM, KIRP, PRAD, SKCM |
| HER2 | L755S (Resistance) | AMPNQAQMRILKETE LRKVKVLGSGAFGTV YKGIWIPDGENVKIPV AIKVSRENTSPKANKE ILDEAYVMAGVGSPY VSRLLGICLTSTVQLV TQLMPYGC (SEQ ID NO: 1211) | KVSRENTSPK (A03.01) (SEQ ID NO: 1263) | BRCA |
| IDH1 | R132G | RVEEFKLKQMWKSPN GTIRNILGGTVFREAII CKNIPRLVSGWVKPII GGHAYGDQYRATDF VVPGPGKVEITYTPSD | KPIIGGHAY (B07.02) (SEQ ID NO: 1264) | BLCA, BRCA, CRC, GBM, HNSC, LUAD, PAAD, PRAD, UCEC |

TABLE 2-continued

| Gene | Exemplary Protein Change | Mutation Sequence Context | Peptides (HLA allele example(s)) | Exemplary Diseases |
|---|---|---|---|---|
| | | GTQKVTYL VHNFEEG GGVAMGM (SEQ ID NO: 1212) | | |
| KRAS | G12C | MTEYKLVVVGACGV GKSALTIQLIQNHFVD EYDPTIEDSYRKQVVI DGETCLLDILDTAGQE (SEQ ID NO: 1213) | KLVVVGACGV (A02.01) (SEQ ID NO: 1265) LVVVGACGV (A02.01) (SEQ ID NO: 1266) VVGACGVGK (A03.01, A11.01) (SEQ ID NO: 1267) VVVGACGVGK (A03.01) (SEQ ID NO: 1268) | BRCA, CESC, CRC, HNSC, LUAD, PAAD, UCEC |
| KRAS | G12D | MTEYKLVVVGADGV GKSALTIQLIQNHFVD EYDPTIEDSYRKQVVI DGETCLLDILDTAGQE (SEQ ID NO: 1214) | VVGADGVGK (A11.01) (SEQ ID NO: 1269) VVVGADGVGK (A11.01) (SEQ ID NO: 1270) KLVVVGADGV (A02.01) (SEQ ID NO: 1271) LVVVGADGV (A02.01) (SEQ ID NO: 1272) | KIRP, LIHC, LUAD, BLCA, BRCA, CESC, CRC, GBM, HNSC, PAAD, SKCM, UCEC |
| KRAS | G12V | MTEYKLVVVGAVGV GKSALTIQLIQNHFVD EYDPTIEDSYRKQVVI DGETCLLDILDTAGQE (SEQ ID NO: 1215) | KLVVVGAVGV (A02.01) (SEQ ID NO: 1273) LVVVGAVGV (A02.01) (SEQ ID NO: 1274) VVGAVGVGK (A03.01, A11.01) (SEQ ID NO: 1275) VVVGAVGVGK (A03.01, A11.01) (SEQ ID NO: 1276) | BRCA, CESC, CRC, LUAD, PAAD, THCA, UCEC |
| KRAS | Q61H | AGGVGKSALTIQLIQN HFVDEYDPTIEDSYRK QVVIDGETCLLDILDT AGHEEYSAMRDQYM RTGEGFLCVFAINNTK SFEDIHHYREQIKRVK DSEDVPM (SEQ ID NO: 1216) | ILDTAGHEEY (A01.01) (SEQ ID NO: 1277) | CRC, LUSC, PAAD, SKCM, UCEC |
| KRAS | Q61L | AGGVGKSALTIQLIQN HFVDEYDPTIEDSYRK QVVIDGETCLLDILDT AGLEEYSAMRDQYM RTGEGFLCVFAINNTK SFEDIHHYREQIKRVK DSEDVPM (SEQ ID NO: 1217) | LLDILDTAGL (A02.01) (SEQ ID NO: 1278) ILDTAGLEEY (A01.01) (SEQ ID NO: 1279) | CRC, GBM, HNSC, LUAD, SKCM, UCEC |
| NRAS | Q61K | AGGVGKSALTIQLIQN HFVDEYDPTIEDSYRK QVVIDGETCLLDILDT AGKEEYSAMRDQYM RTGEGFLCVFAINNSK SFADINLYREQIKRVK DSDDVPM (SEQ ID NO: 1218) | ILDTAGKEEY (A01.01) (SEQ ID NO: 1280) | BLCA, CRC, LIHC, LUAD, LUSC, SKCM, THCA, UCEC |
| NRAS | Q61R | AGGVGKSALTIQLIQN HFVDEYDPTIEDSYRK QVVIDGETCLLDILDT AGREEYSAMRDQYM RTGEGFLCVFAINNSK SFADINLYREQIKRVK DSDDVPM (SEQ ID NO: 1219) | ILDTAGREEY (A01.01) (SEQ ID NO: 1281) | BLCA, CRC, LUSC, PAAD, PRAD, SKCM, THCA, UCEC |
| PIK3CA | E542K | IEEHANWSVSREAGFS YSHAGLSNRLARDNE LRENDKEQLKAISTRD PLSKITEQEKDFLWSH RHYCVTIPEILPKLLLS VKWNSRDEVAQMYC LVKDWPP (SEQ ID NO: 1220) | AISTRDPLSK (A03.01) (SEQ ID NO: 1282) | BLCA, BRCA, CESC, CRC, GBM, HNSC, KIRC, KIRP, LIHC, LUAD, LUSC, PRAD, UCEC |

TABLE 2-continued

| Gene | Exemplary Protein Change | Mutation Sequence Context | Peptides (HLA allele example(s)) | Exemplary Diseases |
|---|---|---|---|---|
| PTEN | R130Q | KFNCRVAQYPFEDHN PPQLELIKPFCEDLDQ WLSEDDNHVAAIHCK AGKGQTGVMICAYLL HRGKFLKAQEALDFY GEVRTRDKKGVTIPSQ RRYVYYYSY (SEQ ID NO: 1221) | QTGVMICAY (A01.01) (SEQ ID NO: 1283) | BRCA, CESC, CRC, GBM, KIRC, LUSC, UCEC |
| RAC1 | P29S | MQAIKCVVVGDGAV GKTCLLISYTTNAFSG EYIPTVFDNYSANVM VDGKPVNLGLWDTA GQEDYDRLRPLSYPQ TVGET (SEQ ID NO: 1222) | FSGEYIPTV (A02.01) (SEQ ID NO: 1284) TTNAFSGEY (A01.01) (SEQ ID NO: 1285) YTTNAFSGEY (A01.01) (SEQ ID NO: 1286) | Melanoma |
| SF3B1 | K700E | AVCKSKKSWQARHT GIKIVQQIAILMGCAIL PHLRSLVEIIEHGLVD EQQEVRTISALAIAAL AEAATPYGIESFDSVL KPLWKGIRQHRGKGL AAFLKAI (SEQ ID NO: 1223) | GLVDEQQEV (A02.01) (SEQ ID NO: 1287) | AML associated with MDS; Chronic lymphocytic leukemia-small lymphocytic lymphoma; Myelodysplastic syndrome; AML; Luminal NS carcinoma of breast; Chronic myeloid leukemia; Ductal carcinoma of pancreas; Chronic myelomonocytic leukemia; Chronic lymphocytic leukemia-small lymphocytic lymphoma; Myelofibrosis; Myelodysplastic syndrome; PRAD; Essential thrombocythaemia; Medullomyoblastoma |
| SPOP | F133L | YLSLYLLLVSCPKSEV RAKFKFSILNAKGEET KAMESQRAYRFVQG KDWGLKKFIRRDFLL DEANGLLPDDKLTLF CEVSVVQDSVNISGQ NTMNMVKVPE (SEQ ID NO: 1224) | FVQGKDWGL (A02.01, B08.01) (SEQ ID NO: 1288) | PRAD |
| SPOP | F133V | YLSLYLLLVSCPKSEV RAKFKFSILNAKGEET KAMESQRAYRFVQG KDWGVKKFIRRDFLL DEANGLLPDDKLTLF CEVSVVQDSVNISGQ NTMNMVKVPE (SEQ ID NO: 1225) | FVQGKDWGV (A02.01) (SEQ ID NO: 1289) | PRAD |
| TP53 | G245S | IRVEGNLRVEYLDDR NTFRHSVVVPYEPPEV GSDCTTIHYNYMCNS SCMGSMNRRPILTIITL EDSSGNLLGRNSFEVR VCACPGRDRRTEEEN LRKKGEP (SEQ ID NO: 1226) | CMGSMNRRPI (A02.01, B08.01) (SEQ ID NO: 1290) GSMNRRPIL (B08.01) (SEQ ID NO: 1291) MGSMNRRPI (A02.01) (SEQ ID NO: 1292) MGSMNRRPIL (B08.01) (SEQ ID NO: 1293) SMNRRPILTI (A02.01, A24.02, B08.01) (SEQ ID NO: 1294) | BLCA, BRCA, CRC, GBM, HNSC, LUSC, PAAD, PRAD |

TABLE 2-continued

| Gene | Exemplary Protein Change | Mutation Sequence Context | Peptides (HLA allele example(s)) | Exemplary Diseases |
|---|---|---|---|---|
| TP53 | R248Q | EGNLRVEYLDDRNTFRHSVVVPYEPPEVGSDCTTIHYNYMCNSSCMGGMNQRPILTIITLEDSSGNLLGRNSFEVRVCACPGRDRRTEEENLRKKGEPHHE (SEQ ID NO: 1227) | CMGGMNQRPI (A02.01, B08.01) (SEQ ID NO: 1295) GMNQRPILTI (A02.01, B08.01) (SEQ ID NO: 1296) NQRPILTII (A02.01, B08.01) (SEQ ID NO: 1297) | GBM, HNSC, KIRC, BLCA, BRCA, CRC, LIHC, LUSC, PAAD, PRAD, UCEC |
| TP53 | R248W | EGNLRVEYLDDRNTFRHSVVVPYEPPEVGSDCTTIHYNYMCNSSCMGGMNWRPILTIITLEDSSGNLLGRNSFEVRVCACPGRDRRTEEENLRKKGEPHHE (SEQ ID NO: 1228) | CMGGMNWRPI (A02.01, A24.02, B08.01) (SEQ ID NO: 1298) GMNWRPILTI (A02.01, B08.01) (SEQ ID NO: 1299) MNWRPILTI (A02.01, A24.02, B08.01) (SEQ ID NO: 1300) MNWRPILTII (A02.01, A24.02) (SEQ ID NO: 1301) | BLCA, BRCA, CRC, GBM, HNSC, LIHC, LUSC, PAAD, SKCM, UCEC |
| TP53 | R273C | PEVGSDCTTIHYNYMCNSSCMGGMNRRPILTIITLEDSSGNLLGRNSFEVCVCACPGRDRRTEEENLRKKGEPHHELPPGSTKRALPNNTSSSPQPKKKPL (SEQ ID NO: 1229) | NSFEVCVCA (A02.01) (SEQ ID NO: 1302) | BLCA, BRCA, CRC, GBM, HNSC, LUSC, PAAD, UCEC |
| TP53 | R273H | PEVGSDCTTIHYNYMCNSSCMGGMNRRPILTIITLEDSSGNLLGRNSFEVHVCACPGRDRRTEEENLRKKGEPHHELPPGSTKRALPNNTSSSPQPKKKPL (SEQ ID NO: 1230) | NSFEVHVCA (A02.01) (SEQ ID NO: 1303) | BRCA, CRC, GBM, HNSC, LIHC, LUSC, PAAD, UCEC |
| TP53 | Y220C | TEVVRRCPHHERCSDSDGLAPPQHLIRVEGNLRVEYLDDRNTFRHSVVVPCEPPEVGSDCTTIHYNYMCNSSCMGGMNRRPILTIITLEDSSGNLLGRNSF (SEQ ID NO: 1231) | VVPCEPPEV (A02.01) (SEQ ID NO: 1304) VVVPCEPPEV (A02.01) (SEQ ID NO: 1305) | BLCA, BRCA, GBM, HNSC, LIHC, LUAD, LUSC, PAAD, SKCM, UCEC |
| Table 2B | | MSI-ASSOCIATED FRAMESHIFTS[1] | | |
| MSH6 | F1088fs; +1 | YNFDKNYKDWQSAVECIAVLDVLLCLANYSRGGDGPMCRPVILLPEDTPPLLRA (SEQ ID NO: 1232) | ILLPEDTPPL (A02.01) (SEQ ID NO: 1306) LLPEDTPPL (A02.01) (SEQ ID NO: 1307) | MSI+ CRC, MSI+ Uterine/Endometrium Cancer, MSI+ Stomach Cancer, Lynch syndrome |
| Table 2C | | FRAMESHIFT[1] | | |
| APC | F1354fs | AKFQQCHSTLEPNPADCRVLVYLQNQPGTKLLNFLQERNLPPKVVLRHPKVHLNTMFRRPHSCLADVLLSVHLIVLRVVRLPAPFRVNHAVEW* (SEQ ID NO: 1233) | APFRVNHAV (B07.02) (SEQ ID NO: 1308) CLADVLLSV (A02.01) (SEQ ID NO: 1309) FLQERNLPPK (A03.01) (SEQ ID NO: 1310) HLIVLRVVRL (A02.01, B08.01) (SEQ ID NO: 1311) HPKVHLNTM (B07.02, B08.01) (SEQ ID NO: 1312) HPKVHLNTMF (B07.02, B08.01) (SEQ ID NO: 1313) KVHLNTMFR (A03.01) (SEQ ID NO: 1314) KVHLNTMFRR (A03.01) (SEQ ID NO: 1315) LPAPFRVNHA (B07.02) (SEQ ID NO: 1316) | CRC, LUAD, UCEC, STAD |

TABLE 2-continued

| Gene | Exemplary Protein Change | Mutation Sequence Context | Peptides (HLA allele example(s)) | Exemplary Diseases |
|---|---|---|---|---|
| | | | MFRRPHSCL (B07.02, B08.01) (SEQ ID NO: 1317) MFRRPHSCLA (B08.01) (SEQ ID NO: 1318) NTMFRRPHSC (B08.01) (SEQ ID NO: 1319) RPHSCLADV (B07.02) (SEQ ID NO: 1320) RPHSCLADVL (B07.02) (SEQ ID NO: 1321) RVVRLPAPFR (A03.01) (SEQ ID NO: 1322) SVHLIVLRV (A02.01) (SEQ ID NO: 1323) TMFRRPHSC (B08.01) (SEQ ID NO: 1324) TMFRRPHSCL (A02.01, B08.01) (SEQ ID NO: 1325) VLLSVHLIV (A02.01) (SEQ ID NO: 1326) VLLSVHLIVL (A02.01) (SEQ ID NO: 1327) VLRVVRLPA (B08.01) (SEQ ID NO: 1328) VVRLPAPFR (A03.01) (SEQ ID NO: 1329) | |
| ARID1A | Y1324fs | ALGPHSRISCLPTQTR GCILLAATPRSSSSSSS NDMIPMAISSPPKAPL LAAPSPASRLQCINSN SRITSGQWMAHMALL PSGTKGRCTACHTAL GRGSLSSSSCPQPSPSL PASNKLPSLPLSKMYT TSMAMPILPLPQLLLS ADQQAAPRTNFHSSL AETVSLHPLAPMPSKT CHHK* (SEQ ID NO: 1234) | AMPILPLPQL (A02.01) (SEQ ID NO: 1330) APLLAAPSPA (B07.02) (SEQ ID NO: 1331) APRTNFHSS (B07.02) (SEQ ID NO: 1332) APRTNFHSSL (B07.02, B08.01) (SEQ ID NO: 1333) CPQPSPSLPA (B07.02) (SEQ ID NO: 1334) GQWMAHMAL (A02.01) (SEQ ID NO: 1335) GQWMAHMALL (A02.01) (SEQ ID NO: 1336) HMALLPSGTK (A03.01) (SEQ ID NO: 1337) HTALGRGSL (B07.02) (SEQ ID NO: 1338) IPMAISSPP (B07.02) (SEQ ID NO: 1339) IPMAISSPPK (B07.02) (SEQ ID NO: 1340) KLPSLPLSK (A03.01) (SEQ ID NO: 1341) KLPSLPLSKM (A02.01) (SEQ ID NO: 1342) KMYTTSMAM (A02.01, A03.01) (SEQ ID NO: 1343) LLAAPSPASR (A03.01) (SEQ ID NO: 1344) LLLSADQQAA (A02.01) (SEQ ID NO: 1345) LLSADQQAA (A02.01) (SEQ ID NO: 1346) LPASNKLPS (B07.02) (SEQ ID NO: 1347) LPASNKLPSL (B07.02, B08.01) (SEQ ID NO: 1348) LPLPQLLLSA (B07.02) (SEQ ID NO: 1349) LPSLPLSKM (B07.02) (SEQ ID NO: 1350) LSKMYTTSM (B08.01) (SEQ ID NO: 1351) MALLPSGTK (A03.01) (SEQ ID NO: 1352) MPILPLPQL (B07.02) (SEQ ID NO: 1353) | STAD, UCEC, BLCA, BRCA, LUSC, CESC, KIRC, UCS |

TABLE 2-continued

| Gene | Exemplary Protein Change | Mutation Sequence Context | Peptides (HLA allele example(s)) | Exemplary Diseases |
|---|---|---|---|---|
| | | | MPILPLPQLL (B07.02) (SEQ ID NO: 1354) | |
| | | | MYTTSMAMPI (A24.02) (SEQ ID NO: 1355) | |
| | | | PMAISSPPK (A03.01) (SEQ ID NO: 1356) | |
| | | | QWMAHMALL (A24.02) (SEQ ID NO: 1357) | |
| | | | SKMYTTSMAM (B07.02) (SEQ ID NO: 1358) | |
| | | | SMAMPILPL (A02.01, B07.02, B08.01) (SEQ ID NO: 1359) | |
| | | | SNKLPSLPL (B08.01) (SEQ ID NO: 1360) | |
| | | | SPASRLQCI (B07.02, B08.01) (SEQ ID NO: 1361) | |
| | | | SPPKAPLLAA (B07.02) (SEQ ID NO: 1362) | |
| | | | SPSLPASNKL (B07.02) (SEQ ID NO: 1363) | |
| | | | YTTSMAMPI (A02.01) (SEQ ID NO: 1364) | |
| | | | YTTSMAMPIL (A02.01) (SEQ ID NO: 1365) | |
| ARID1A | G1848fs | RSYRRMIHLWWTAQI SLGVCRSLTVACCTG GLVGGTPLSISRPTSR ARQSCCLPGLTHPAH QPLGSM* (SEQ ID NO: 1235) | CLPGLTHPA (A02.01) (SEQ ID NO: 1366)<br>GLTHPAHQPL (A02.01) (SEQ ID NO: 1367)<br>HPAHQPLGSM (B07.02) (SEQ ID NO: 1368)<br>LTHPAHQPL (B07.02) (SEQ ID NO: 1369)<br>RPTSRARQSC (B07.02) (SEQ ID NO: 1370)<br>RQSCCLPGL (A02.01) (SEQ ID NO: 1371)<br>TSRARQSCCL (B08.01) (SEQ ID NO: 1372) | STAD, UCEC, BLCA, BRCA, LUSC, CESC, KIRC, UCS |
| ß2M | L13fs | QHSGRDVSLRGLSCA RATLSFWPGGYPAYS KDSGLLTSSSREWKV KFPELLCVWVSSIRH* (SEQ ID NO: 1236) | ELLCVWVSSI (A02.01) (SEQ ID NO: 1373)<br>EWKVKFPEL (B08.01) (SEQ ID NO: 1374)<br>KFPELLCVW (A24.02) (SEQ ID NO: 1375)<br>LLCVWVSSI (A02.01) (SEQ ID NO: 1376)<br>LLTSSSREWK (A03.01) (SEQ ID NO: 1377)<br>LTSSSREWK (A03.01) (SEQ ID NO: 1378)<br>YPAYSKDSGL (B07.02) (SEQ ID NO: 1379) | CRC, STAD, SKCM, HNSC |
| GATA3 | L328fs<br>N334fs | AQAKAVCSQESRDVL CELSDHHNHTLEEEC QWGPCLQCLWALLQ ASQY* (SEQ ID NO: 1237) | CLQCLWALL (A02.01) (SEQ ID NO: 1380)<br>CQWGPCLQCL (A02.01) (SEQ ID NO: 1381)<br>QWGPCLQCL (A24.02) (SEQ ID NO: 1382)<br>QWGPCLQCLW (A24.02) (SEQ ID NO: 1383) | Breast Cancer |
| GATA3 | H400fs<br>S408fs<br>S408fs<br>S430fs<br>H434fs<br>H435fs | PGRPLQTHVLPEPHLA LQPLQPHADHAHADA PAIQPVLWTTPPLQHG HRHGLEPCSMLTGPP ARVPAVPFDLHFCRSS IMKPKRDGYMFLKAE SKIMFATLQRSSLWCL CSNH* (SEQ ID NO: 1238) | AIQPVLWTT (A02.01) (SEQ ID NO: 1384)<br>ALQPLQPHA (A02.01) (SEQ ID NO: 1385)<br>DLHFCRSSIM (B08.01) (SEQ ID NO: 1386)<br>EPHLALQPL (B07.02, B08.01) (SEQ ID NO: 1387)<br>ESKIMFATL (B08.01) (SEQ ID NO: 1388)<br>FATLQRSSL (B07.02, B08.01) (SEQ ID NO: 1389) | Breast Cancer |

TABLE 2-continued

| Gene | Exemplary Protein Change | Mutation Sequence Context | Peptides (HLA allele example(s)) | Exemplary Diseases |
|---|---|---|---|---|
| | | | FLKAESKIM (B08.01) (SEQ ID NO: 1390) | |
| | | | FLKAESKIMF (B08.01) (SEQ ID NO: 1391) | |
| | | | GPPARVPAV (B07.02) (SEQ ID NO: 1392) | |
| | | | IMKPKRDGYM (B08.01) (SEQ ID NO: 1393) | |
| | | | KIMFATLQR (A03.01) (SEQ ID NO: 1394) | |
| | | | KPKRDGYMF (B07.02) (SEQ ID NO: 1395) | |
| | | | KPKRDGYMFL (B07.02) (SEQ ID NO: 1396) | |
| | | | LHFCRSSIM (B08.01) (SEQ ID NO: 1397) | |
| | | | LQHGRHGL (B08.01) (SEQ ID NO: 1398) | |
| | | | MFATLQRSSL (B07.02, B08.01) (SEQ ID NO: 1399) | |
| | | | MFLKAESKI (A24.02) (SEQ ID NO: 1400) | |
| | | | MLTGPPARV (A02.01) (SEQ ID NO: 1401) | |
| | | | QPVLWTTPPL (B07.02) (SEQ ID NO: 1402) | |
| | | | SMLTGPPARV (A02.01) (SEQ ID NO: 1403) | |
| | | | TLQRSSLWCL (A02.01) (SEQ ID NO: 1404) | |
| | | | VLPEPHLAL (A02.01) (SEQ ID NO: 1405) | |
| | | | VPAVPFDLHF (B07.02) (SEQ ID NO: 1406) | |
| | | | YMFLKAESK (A03.01) (SEQ ID NO: 1407) | |
| | | | YMFLKAESKI (A02.01, A03.01, A24.02, B08.01) (SEQ ID NO: 1408) | |
| MLL2 | P647fs L656fs | TRRCHCCPHLRSHPCP HHLRNHPRPHHLRHH ACHHHLRNCPHPHFL RHCTCPGRWRNRPSL RRLRSLLCLPHLNHHL FLHWRSRPCLHRKSH PHLLHLRRLYPHHLK HRPCPHHLKNLLCPR HLRNCPLPRHLKHLA CLHHLRSHPCPLHLKS HPCLHHRRHLVCSHH LKSLLCPLHLRSLPFP HHLRHHACPHHLRTR LCPHHLKNHLCPPHL RYRAYPPCLWCHACL HRLRNLPCPHRLRSLP RPLHLRLHASPHHLRT PPHPHHLRTHLLPHHR RTRSCPCRWRSHPCC HYLRSRNSAPGPRGR TCHPGLRSRTCPPGLR SHTYLRRLRSHTCPPS LRSHAYALCLRSHTCP PRLRDHICPLSLRNCT CPPRLRSRTCLLCLRS HACPPNLRNHTCPPSL RSHACPPGLRNRICPL SLRSHPCPLGLKSPLR SQANALHLRSCPCSLP LGNHPYLPCLESQPCL SLGNHLCPLCPRSCRC PHLGSHPCRLS* (SEQ ID NO: 1239) | APGPRGRTC (B07.02) (SEQ ID NO: 1409)<br>CLRSHTCPPR (A03.01) (SEQ ID NO: 1410)<br>CLWCHACLHR (A03.01) (SEQ ID NO: 1411)<br>CPHLGSHPC (B07.02) (SEQ ID NO: 1412)<br>CPLGLKSPL (B07.02) (SEQ ID NO: 1413)<br>CPRSCRCPH (B07.02) (SEQ ID NO: 1414)<br>CPRSCRCPHL (B07.02, B08.01) (SEQ ID NO: 1415)<br>CSLPLGNHPY (A01.01) (SEQ ID NO: 1416)<br>GLRNRICPL (A02.01, B07.02, B08.01) (SEQ ID NO: 1417)<br>GLRSHTYLR (A03.01) (SEQ ID NO: 1418)<br>GLRSHTYLRR (A03.01) (SEQ ID NO: 1419)<br>GPRGRTCHPG (B07.02) (SEQ ID NO: 1420)<br>HLGSHPCRL (B08.01) (SEQ ID NO: 1421)<br>HLRLHASPH (A03.01) (SEQ ID NO: 1422)<br>HLRSCPCSL (B07.02, B08.01) (SEQ ID NO: 1423)<br>HLRTHLLPH (A03.01) (SEQ ID NO: 1424)<br>HLRTHLLPHH (A03.01) (SEQ ID NO: 1425)<br>HLRYRAYPP (B08.01) (SEQ ID NO: 1426) | STAD, BLCA, CRC, HNSC, BRCA |

TABLE 2-continued

| Gene | Exemplary Protein Change | Mutation Sequence Context | Peptides (HLA allele example(s)) | Exemplary Diseases |
|---|---|---|---|---|
| | | | HLRYRAYPPC (B08.01) (SEQ ID NO: 1427) | |
| | | | HPHHLRTHL (B07.02) (SEQ ID NO: 1428) | |
| | | | HPHHLRTHLL (B07.02, B08.01) (SEQ ID NO: 1429) | |
| | | | HTYLRRLRSH (A03.01) (SEQ ID NO: 1430) | |
| | | | LPCPHRLRSL (B07.02, B08.01) (SEQ ID NO: 1431) | |
| | | | LPHHRRTRSC (B07.02, B08.01) (SEQ ID NO: 1432) | |
| | | | LPLGNHPYL (B07.02) (SEQ ID NO: 1433) | |
| | | | LPRPLHLRL (B07.02, B08.01) (SEQ ID NO: 1434) | |
| | | | NLRNHTCPP (B08.01) (SEQ ID NO: 1435) | |
| | | | PPRLRSRTCL (B07.02, B08.01) (SEQ ID NO: 1436) | |
| | | | RLHASPHHL (A02.01) (SEQ ID NO: 1437) | |
| | | | RLHASPHHLR (A03.01) (SEQ ID NO: 1438) | |
| | | | RLRDHICPL (A02.01, B07.02, B08.01) (SEQ ID NO: 1439) | |
| | | | RLRNLPCPH (A03.01) (SEQ ID NO: 1440) | |
| | | | RLRNLPCPHR (A03.01) (SEQ ID NO: 1441) | |
| | | | RLRSHTCPP (B08.01) (SEQ ID NO: 1442) | |
| | | | RLRSLPRPL (B07.02, B08.01) (SEQ ID NO: 1443) | |
| | | | RLRSLPRPLH (A03.01) (SEQ ID NO: 1444) | |
| | | | RLRSRTCLL (B07.02, B08.01) (SEQ ID NO: 1445) | |
| | | | RNRICPLSL (B07.02, B08.01) (SEQ ID NO: 1446) | |
| | | | RPLHLRLHA (B07.02) (SEQ ID NO: 1447) | |
| | | | RPLHLRLHAS (B07.02) (SEQ ID NO: 1448) | |
| | | | RSHACPPGLR (A03.01) (SEQ ID NO: 1449) | |
| | | | RSHACPPNLR (A03.01) (SEQ ID NO: 1450) | |
| | | | RSHAYALCLR (A03.01) (SEQ ID NO: 1451) | |
| | | | RSHPCCHYLR (A03.01) (SEQ ID NO: 1452) | |
| | | | RSHPCPLGLK (A03.01) (SEQ ID NO: 1453) | |
| | | | RSHTCPPSLR (A03.01) (SEQ ID NO: 1454) | |
| | | | RSLPRPLHLR (A03.01) (SEQ ID NO: 1455) | |
| | | | RSRTCLLCL (B07.02) (SEQ ID NO: 1456) | |
| | | | RSRTCLLCLR (A03.01) (SEQ ID NO: 1457) | |
| | | | RSRTCPPGL (B07.02) (SEQ ID NO: 1458) | |
| | | | RSRTCPPGLR (A03.01) (SEQ ID NO: 1459) | |
| | | | RTHLLPHHRR (A03.01) (SEQ ID NO: 1460) | |
| | | | RTRSCPCRWR (A03.01) (SEQ ID NO: 1461) | |
| | | | RYRAYPPCL (A24.02) (SEQ ID NO: 1462) | |
| | | | RYRAYPPCLW (A24.02) (SEQ ID NO: 1463) | |
| | | | SLGNHLCPL (A02.01, B07.02, B08.01) (SEQ ID NO: 1464) | |

TABLE 2-continued

| Gene | Exemplary Protein Change | Mutation Sequence Context | Peptides (HLA allele example(s)) | Exemplary Diseases |
|---|---|---|---|---|
| | | | SLPLGNHPYL (A02.01) (SEQ ID NO: 1465) SLPRPLHLRL (A02.01) (SEQ ID NO: 1466) SLRNCTCPPR (A03.01) (SEQ ID NO: 1467) SLRSHAYAL (A02.01, B07.02, B08.01) (SEQ ID NO: 1468) SLRSHPCPL (A02.01, B07.02, B08.01) (SEQ ID NO: 1469) SPHHLRTPP (B07.02) (SEQ ID NO: 1470) SPHHLRTPPH (B07.02) (SEQ ID NO: 1471) SPLRSQANAL (B07.02, B08.01) (SEQ ID NO: 1472) YLRRLRSHTC (B08.01) (SEQ ID NO: 1473) YLRSRNSAP (B08.01) (SEQ ID NO: 1474) YLRSRNSAPG (B08.01) (SEQ ID NO: 1475) | |
| MLL2 | P2354fs | GPRSHPLPRLWHLLL QVTQTSFALAPTLTH MLSPH* (SEQ ID NO: 1240) | ALAPTLTHM (A02.01) (SEQ ID NO: 1476) ALAPTLTHML (A02.01) (SEQ ID NO: 1477) LLQVTQTSFA (A02.01) (SEQ ID NO: 1478) LQVTQTSFAL (A02.01) (SEQ ID NO: 1479) RLWHLLLQV (A02.01) (SEQ ID NO: 1480) RLWHLLLQVT (A02.01) (SEQ ID NO: 1481) | STAD, BLCA, CRC, HNSC, BRCA |
| RNF43 | G659fs | PLGLVPWTRWCPQGK PRFPAMSTTTATGTTT TKSGSSGMAGSLAQK PESPSPGLLFLGHSPSQ SHLLLISKSPDPTQQPL RGGSLTHSAPGPSLSQ PLAQLTPPASAPVPAV CSTCKNPASLPDTHRG KGGGVPPSPPLALGPR MQLCTQLARFFPITPP VWHILGPQRHTP* (SEQ ID NO: 1241) | CTQLARFFPI (A24.02) (SEQ ID NO: 1482) FFPITPPVW (A24.02) (SEQ ID NO: 1483) FPITPPVWHI (B07.02) (SEQ ID NO: 1484) GPRMQLCTQL (B07.02, B08.01) (SEQ ID NO: 1485) ITPPVWHIL (A24.02) (SEQ ID NO: 1486) LALGPRMQL (B07.02) (SEQ ID NO: 1487) MQLCTQLARF (A24.02) (SEQ ID NO: 1488) RFFPITPPV (A02.01, A24.02) (SEQ ID NO: 1489) RFFPITPPVW (A24.02) (SEQ ID NO: 1490) RMQLCTQLA (A02.01) (SEQ ID NO: 1491) RMQLCTQLAR (A03.01) (SEQ ID NO: 1492) SPPLALGPRM (B07.02) (SEQ ID NO: 1493) TQLARFFPI (A02.01, A24.02, B08.01) (SEQ ID NO: 1494) | STAD |
| SMAP1 | E169fs | KYEKKKYYDKNAIAI TNISSSDAPLQPLVSSP SLQAAVDKNKLEKEK EKKRKRKREKRSQKS RQNHLQLKSCRRKISN WSLKKVPALKKLRSP LWIF (SEQ ID NO: 1242) | KSRQNHLQL (B07.02) (SEQ ID NO: 1495) ALKKLRSPL (B08.01, B07.02) (SEQ ID NO: 1496) HLQLKSCRRK (A03.01) (SEQ ID NO: 1497) KISNWSLKK (A03.01, A11.01) (SEQ ID NO: 1498) KISNWSLKKV (A03.01) (SEQ ID NO: 1499) KLRSPLWIF (A24.02) (SEQ ID NO: 1500) | MSI+ CRC, MSI+ Uterine/Endometrium Cancer, MSI+ Stomach Cancer |

TABLE 2-continued

| Gene | Exemplary Protein Change | Mutation Sequence Context | Peptides (HLA allele example(s)) | Exemplary Diseases |
|---|---|---|---|---|
| | | | KSRQNHLQLK (A03.01) (SEQ ID NO: 1501) NWSLKKVPAL (B08.01) (SEQ ID NO: 1502) SLKKVPALK (A03.01, A11.01) (SEQ ID NO: 1503) SLKKVPALKK (A03.01) (SEQ ID NO: 1504) SQKSRQNHL (B08.01) (SEQ ID NO: 1505) WSLKKVPAL (B08.01) (SEQ ID NO: 1506) WSLKKVPALK (A03.01) (SEQ ID NO: 1507) | |
| TP53 | P58fs P72fs G108fs R110fs | CCPRTILNNGSLKTQV QMKLPECQRLLPPWP LHQQLLHRRPLHQPPP GPCHLLSLPRKPTRAA TVSVWASCILGQPSL* (SEQ ID NO: 1243) | KLPECQRLL (A02.01) (SEQ ID NO: 1508) KPTRAATVSV (B07.02) (SEQ ID NO: 1509) LPPWPLHQQL (B07.02) (SEQ ID NO: 1510) LPRKPTRAA (B07.02, B08.01) (SEQ ID NO: 1511) LPRKPTRAAT (B07.02) (SEQ ID NO: 1512) QQLLHRRPL (B08.01) (SEQ ID NO: 1513) RLLPPWPLH (A03.01) (SEQ ID NO: 1514) | BRCA, CRC, LUAD, PRAD, HNSC, LUSC, PAAD, STAD, BLCA, OV, LIHC, SKCM, UCEC, LAML, UCS, KICH, GBM, ACC |
| TP53 | P152fs | LARTPLPSTRCFANWP RPALCSCGLIPHPRPA PASAPWPSTSSHST* (SEQ ID NO: 1244) | APWPSTSSH (B07.02) (SEQ ID NO: 1515) APASAPWPST (B07.02) (SEQ ID NO: 1516) RPAPASAPW (B07.02) (SEQ ID NO: 1517) WPSTSSHST (B07.02) (SEQ ID NO: 1518) | PRAD, HNSC, LUSC, BRCA, CRC, LUAD, PAAD, STAD, BLCA, OV, LIHC, SKCM, UCEC, LAML, UCS, KICH, GBM, ACC |
| UBR5 | K2120fs | SQGLYSSSASSGKCL MEVTVDRNCLEVLPT KMSYAANLKNVMNM QNRQKKKGKNSPCCQ KKLRVQNQGHLLMIL LHN* (SEQ ID NO: 1245) | RVQNQGHLL (B07.02) (SEQ ID NO: 1519) | |
| VHL | L116fs G123fs | TRASPPRSSSAIAVRA SCCPYGSTSTASRSPT QRCRLARAAASTATE VTFGSSEMQGHTMGF WLTKLNYLCHLSMLT DSLFLPISHCQCIL* (SEQ ID NO: 1246) | FLPISHCQCI (A02.01) (SEQ ID NO: 1520) FWLTKLNYL (A24.02, B08.01) (SEQ ID NO: 1521) HLSMLTDSL (A02.01) (SEQ ID NO: 1522) HTMGFWLTK (A03.01) (SEQ ID NO: 1523) HTMGFWLTKL (A02.01) (SEQ ID NO: 1524) KLNYLCHLSM (A02.01) (SEQ ID NO: 1525) LPISHCQCI (B07.02, B08.01) (SEQ ID NO: 1526) LPISHCQCIL (B07.02, B08.01) (SEQ ID NO: 1527) LTDSLFLPI (A01.01, A02.01) (SEQ ID NO: 1528) LTKLNYLCHL (B08.01) (SEQ ID NO: 1529) MLTDSLFLPI (A01.01, A02.01, B08.01) (SEQ ID NO: 1530) MQGHTMGFWL (A02.01) (SEQ ID NO: 1531) NYLCHLSML (A24.02) (SEQ ID NO: 1532) SMLTDSLFL (A02.01) (SEQ ID NO: 1533) | KIRC, KIRP |

TABLE 2-continued

| Gene | Exemplary Protein Change | Mutation Sequence Context | Peptides (HLA allele example(s)) | Exemplary Diseases |
|---|---|---|---|---|
| | | | TMGFWLTKL (A02.01) (SEQ ID NO: 1534) YLCHLSMLT (A02.01) (SEQ ID NO: 1535) | |
| TABLE 2D | | INSERT[1] | | |
| HER2 | G776ins YVMA | LGSGAFGTVYKGIWIP DGENVKIPVAIKVLRE NTSPKANKEILDEAYV MA<u>YVMA</u>GVGSPYVS RLLGICLTSTVQLVTQ LMPYGCLLDHVRENR GRLGSQDLLNW (SEQ ID NO: 1247) | ILDEAYVMAY (A01.01) (SEQ ID NO: 1536) VMAYVMAGV (A02.01) (SEQ ID NO: 1537) YVMAYVMAG (A02.01, B07.02, B08.01) (SEQ ID NO: 1538) YVMAYVMAGV (A02.01, B07.02, B08.01) (SEQ ID NO: 1539) | Lung Cancer |

[1]Underlined AAs represent non-native AAs
[2]Bolded AAs represent native AAs of the amino acid sequence encoded by the second of the two fused genes
[3]Bolded and underlined AAs represent non-native AAs of the amino acid sequence encoded by the second of the two fused genes due to a frameshift.

In the Tables above, for one or more of the exemplary fusions, a sequence that comes before the first ":" belongs to an exon sequence of a polypeptide encoded by a first gene, a sequence that comes after the second ":" belongs to an exon sequence of a polypeptide encoded by a second gene, and an amino acid that appears between ":" symbols is encoded by a codon that is split between the exon sequence of a polypeptide encoded by a first gene and the exon sequence of a polypeptide encoded by a second gene.

However, in some embodiments, for example, NAB: STAT6, the NAB exon is linked to the 5' UTR of STAT6 and the first amino acid that appears after the junction is the normal start codon of STAT6 (there is no frame present at this site (as it is not normally translated).

AR-V7 in the tables above can also be considered, in some embodiments, a splice variant of the AR gene that encodes a protein that lacks the ligand binding domain found in full length AR.

In some embodiments, sequencing methods are used to identify tumor specific mutations. Any suitable sequencing method can be used according to the present disclosure, for example, Next Generation Sequencing (NGS) technologies. Third Generation Sequencing methods might substitute for the NGS technology in the future to speed up the sequencing step of the method. For clarification purposes: the terms "Next Generation Sequencing" or "NGS" in the context of the present disclosure mean all novel high throughput sequencing technologies which, in contrast to the "conventional" sequencing methodology known as Sanger chemistry, read nucleic acid templates randomly in parallel along the entire genome by breaking the entire genome into small pieces. Such NGS technologies (also known as massively parallel sequencing technologies) are able to deliver nucleic acid sequence information of a whole genome, exome, transcriptome (all transcribed sequences of a genome) or methylome (all methylated sequences of a genome) in very short time periods, e.g. within 1-2 weeks, for example, within 1-7 days or within less than 24 hours and allow, in principle, single cell sequencing approaches. Multiple NGS platforms which are commercially available or which are mentioned in the literature can be used in the context of the present disclosure e.g. those described in detail in WO 2012/159643.

In certain embodiments, the peptide described herein can comprise, but is not limited to, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, about 40, about 41, about 42, about 43, about 44, about 45, about 46, about 47, about 48, about 49, about 50, about 60, about 70, about 80, about 90, about 100, about 110, about 120, about 150, about 200, about 300, about 350, about 400, about 450, about 500, about 600, about 700, about 800, about 900, about 1,000, about 1,500, about 2,000, about 2,500, about 3,000, about 4,000, about 5,000, about 7,500, about 10,000 amino acids or greater amino acid residues, and any range derivable therein. In specific embodiments, a neoantigenic peptide molecule is equal to or less than 100 amino acids.

In some embodiments, the peptides can be from about 8 and about 50 amino acid residues in length, or from about 8 and about 30, from about 8 and about 20, from about 8 and about 18, from about 8 and about 15, or from about 8 and about 12 amino acid residues in length. In some embodiments, the peptides can be from about 8 and about 500 amino acid residues in length, or from about 8 and about 450, from about 8 and about 400, from about 8 and about 350, from about 8 and about 300, from about 8 and about 250, from about 8 and about 200, from about 8 and about 150, from about 8 and about 100, from about 8 and about 50, or from about 8 and about 30 amino acid residues in length.

In some embodiments, the peptides can be at least 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more amino acid residues in length. In some embodiments, the peptides can be at least 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 70, 80, 90, 100, 150, 200, 250, 300, 350, 400, 450, 500, or more amino acid residues in length. In some embodiments, the peptides can be at most 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or less amino acid residues in length. In some embodiments, the peptides can be at most 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 70, 80, 90, 100, 150, 200, 250, 300, 350, 400, 450, 500, or less amino acid residues in length.

In some embodiments, the peptides has a total length of at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 40, at least 50, at least 60, at least 70, at least 80, at least 90, at least 100, at least 150, at least 200, at least 250, at least 300, at least 350, at least 400, at least 450, or at least 500 amino acids.

In some embodiments, the peptides has a total length of at most 8, at most 9, at most 10, at most 11, at most 12, at most 13, at most 14, at most 15, at most 16, at most 17, at most 18, at most 19, at most 20, at most 21, at most 22, at most 23, at most 24, at most 25, at most 26, at most 27, at most 28, at most 29, at most 30, at most 40, at most 50, at most 60, at most 70, at most 80, at most 90, at most 100, at most 150, at most 200, at most 250, at most 300, at most 350, at most 400, at most 450, or at most 500 amino acids.

A longer peptide can be designed in several ways. In some embodiments, when HLA-binding peptides are predicted or known, a longer peptide comprises (1) individual binding peptides with extensions of 2-5 amino acids toward the N- and C-terminus of each corresponding gene product; or (2) a concatenation of some or all of the binding peptides with extended sequences for each. In other embodiments, when sequencing reveals a long (>10 residues) neoepitope sequence present in the tumor (e.g., due to a frameshift, read-through or intron inclusion that leads to a novel peptide sequence), a longer peptide could consist of the entire stretch of novel tumor-specific amino acids as either a single longer peptide or several overlapping longer peptides. In some embodiments, use of a longer peptide is presumed to allow for endogenous processing by patient cells and can lead to more effective antigen presentation and induction of T cell responses. In some embodiments, two or more peptides can be used, where the peptides overlap and are tiled over the long neoantigenic peptide.

In some embodiments, the peptides can have a pI value of from about 0.5 to about 12, from about 2 to about 10, or from about 4 to about 8. In some embodiments, the peptides can have a pI value of at least 4.5, 5, 5.5, 6, 6.5, 7, 7.5, or more. In some embodiments, the peptides can have a pI value of at most 4.5, 5, 5.5, 6, 6.5, 7, 7.5, or less.

In some embodiments, the peptide described herein can be in solution, lyophilized, or can be in crystal form. In some embodiments, the peptide described herein can be prepared synthetically, by recombinant DNA technology or chemical synthesis, or can be isolated from natural sources such as native tumors or pathogenic organisms. Neoepitopes can be synthesized individually or joined directly or indirectly in the peptide. Although the peptide described herein can be substantially free of other naturally occurring host cell proteins and fragments thereof, in some embodiments, the peptide can be synthetically conjugated to be joined to native fragments or particles.

In some embodiments, the peptide described herein can be prepared in a wide variety of ways. In some embodiments, the peptides can be synthesized in solution or on a solid support according to conventional techniques. Various automatic synthesizers are commercially available and can be used according to known protocols. See, for example, Stewart & Young, Solid Phase Peptide Synthesis, 2d. Ed., Pierce Chemical Co., 1984. Further, individual peptides can be joined using chemical ligation to produce larger peptides that are still within the bounds of the present disclosure.

Alternatively, recombinant DNA technology can be employed wherein a nucleotide sequence which encodes the peptide inserted into an expression vector, transformed or transfected into an appropriate host cell and cultivated under conditions suitable for expression. These procedures are generally known in the art, as described generally in Sambrook et al., Molecular Cloning, A Laboratory Manual, Cold Spring Harbor Press, Cold Spring Harbor, N.Y. (1989). Thus, recombinant peptides, which comprise one or more neoantigenic peptides described herein, can be used to present the appropriate T cell epitope.

In some embodiments, the peptide is encoded by a gene with a point mutation resulting in an amino acid substitution of the native peptide. In some embodiments, the peptide is encoded by a gene with a point mutation resulting in frame shift mutation. A frameshift occurs when a mutation disrupts the normal phase of a gene's codon periodicity (also known as "reading frame"), resulting in the translation of a non-native protein sequence. It is possible for different mutations in a gene to achieve the same altered reading frame. In some embodiments, the peptide is encoded by a gene with a mutation resulting in fusion polypeptide, in-frame deletion, insertion, expression of endogenous retroviral polypeptides, and tumor-specific overexpression of polypeptides. In some embodiments, the peptide is encoded by a fusion of a first gene with a second gene. In some embodiments, the peptide is encoded by an in-frame fusion of a first gene with a second gene. In some embodiments, the peptide is encoded by a fusion of a first gene with an exon of a splice variant of the first gene. In some embodiments, the peptide is encoded by a fusion of a first gene with a cryptic exon of the first gene. In some embodiments, the peptide is encoded by a fusion of a first gene with a second gene, wherein the peptide comprises an amino acid sequence encoded by an out of frame sequence resulting from the fusion.

In some aspects, the present disclosure provides a composition comprising at least two or more than two peptides. In some embodiments, the composition described herein contains at least two distinct peptides. In some embodiments, the composition described herein contains a first peptide comprising a first neoepitope and a second peptide comprising a second neoepitope. In some embodiments, the first and second peptides are derived from the same protein. The at least two distinct peptides may vary by length, amino acid sequence or both. The peptides can be derived from any protein known to or have been found to contain a tumor specific mutation. In some embodiments, the composition described herein comprises a first peptide comprising a first neoepitope of a protein and a second peptide comprising a second neoepitope of the same protein, wherein the first peptide is different from the second peptide, and wherein the first neoepitope comprises a mutation and the second neoepitope comprises the same mutation. In some embodiments, the composition described herein comprises a first peptide comprising a first neoepitope of a first region of a protein and a second peptide comprising a second neoepitope of a second region of the same protein, wherein the first region comprises at least one amino acid of the second region, wherein the first peptide is different from the second peptide and wherein the first neoepitope comprises a first mutation and the second neoepitope comprises a second mutation. In some embodiments, the first mutation and the second mutation are the same. In some embodiments, the mutation is selected from the group consisting of a point mutation, a splice-site mutation, a frameshift mutation, a read-through mutation, a gene fusion mutation and any combination thereof.

In some embodiments, the peptide can be derived from a protein with a substitution mutation, e.g., the KRAS G12C, G12D, G12V, Q61H or Q61L mutation, or the NRAS Q61K or Q61R mutation. The substitution may be positioned anywhere along the length of the peptide. For example, it can be located in the N terminal third of the peptide, the central third of the peptide or the C terminal third of the peptide. In another embodiment, the substituted residue is located 2-5 residues away from the N terminal end or 2-5 residues away from the C terminal end. The peptides can similarly derived from tumor specific insertion mutations where the peptide comprises one or more, or all of the inserted residues.

In some embodiments, the first peptide comprises at least one an additional mutation. In some embodiments, one or more of the at least one additional mutation is not a mutation in the first neoepitope. In some embodiments, one or more of the at least one additional mutation is a mutation in the first neoepitope. In some embodiments, the second peptide comprises at least one additional mutation. In some embodiments, one or more of the at least one additional mutation is not a mutation in the second neoepitope. In some embodiments, one or more of the at least one additional mutation is a mutation in the second neoepitope.

In some aspects, the present disclosure provides a composition comprising a single polypeptide comprises the first peptide and the second peptide, or a single polynucleotide encodes the first peptide and the second peptide. In some embodiments, the composition provided herein comprises one or more additional peptides, wherein the one or more additional peptides comprise a third neoepitope. In some embodiments, the first peptide and the second peptide are encoded by a sequence transcribed from the same transcription start site. In some embodiments, the first peptide is encoded by a sequence transcribed from a first transcription start site and the second peptide is encoded by a sequence transcribed from a second transcription start site. In some embodiments, wherein the polypeptide has a length of at least 26; 27; 28; 29; 30; 40; 50; 60; 70; 80; 90; 100; 150; 200; 250; 300; 350; 400; 450; 500; 600; 700; 800; 900; 1,000; 1,500; 2,000; 2,500; 3,000; 4,000; 5,000; 7,500; or 10,000 amino acids. In some embodiments, the polypeptide comprises a first sequence with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a corresponding wild-type sequence; and a second sequence with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a corresponding wild-type sequence. In some embodiments, the polypeptide comprises a first sequence of at least 8 or 9 contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a corresponding wild-type sequence; and a second sequence of at least 16 or 17 contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a corresponding wild-type sequence.

In some embodiments, the second peptide is longer than the first peptide. In some embodiments, the first peptide is longer than the second peptide. In some embodiments, the first peptide has a length of at least 9; 10; 11; 12; 13; 14; 15; 16; 17; 18; 19; 20; 21; 22; 23; 24; 25; 26; 27; 28; 29; 30; 40; 50; 60; 70; 80; 90; 100; 150; 200; 250; 300; 350; 400; 450; 500; 600; 700; 800; 900; 1,000; 1,500; 2,000; 2,500; 3,000; 4,000; 5,000; 7,500; or 10,000 amino acids. In some embodiments, the second peptide has a length of at least 17; 18; 19; 20; 21; 22; 23; 24; 25; 26; 27; 28; 29; 30; 40; 50; 60; 70; 80; 90; 100; 150; 200; 250; 300; 350; 400; 450; 500; 600; 700; 800; 900; 1,000; 1,500; 2,000; 2,500; 3,000; 4,000; 5,000; 7,500; or 10,000 amino acids. In some embodiments, the first peptide comprises a sequence of at least 9 contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity to a corresponding wild-type sequence. In some embodiments, the second peptide comprises a sequence of at least 17 contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a corresponding wild-type sequence.

In some embodiments, the first peptide, the second peptide or both comprise at least one flanking sequence, wherein the at least one flanking sequence is upstream or downstream of the neoepitope. In some embodiments, the at least one flanking sequence has at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild-type sequence. In some embodiments, the at least one flanking sequence comprises a non-wild-type sequence. In some embodiments, the at least one flanking sequence is a N-terminus flanking sequence. In some embodiments, the at least one flanking sequence is a C-terminus flanking sequence. In some embodiments, the at least one flanking sequence of the first peptide has at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the at least one flanking sequence of the second peptide. In some embodiments, the at least one flanking region of the first peptide is different from the at least one flanking region of the second peptide. In some embodiments, the at least one flanking residue comprises the mutation.

In some embodiments, a peptide comprises a neoepitope sequence comprising at least one mutant amino acid. In some embodiments, a peptide comprises a neoepitope sequence comprising at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more mutant amino acids. In some embodiments, a peptide comprises a neoepitope sequence derived from a protein comprising at least one mutant amino acid and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more non-mutant amino acids. In some embodiments, a peptide comprises a neoepitope sequence derived from a protein comprising at least one mutant amino acid and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more non-mutant amino acids upstream of the least one mutant amino acid. In some embodiments, a peptide comprises a neoepitope sequence derived from a protein comprising at least one mutant amino acid and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more non-mutant amino acids downstream of the least one mutant amino acid. In some embodiments, a peptide comprises a neoepitope sequence derived from a protein comprising at least one mutant amino acid; at least 1, 2, 3, 4, 5, 6, 7, 8, 9, 10, 11, 12, 13, 14, 15, 16, 17, 18, 19, 20, 21, 22, 23, 24, 25, 26, 27, 28, 29,30 or more non-mutant amino acids upstream of the least one mutant amino acid; and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more non-mutant amino acids downstream of the least one mutant amino acid.

In some embodiments, a peptide comprises a neoantigenic peptide sequence depicted in Tables 1 to 14. In some embodiments, a peptide comprises a neoepitope sequence depicted in Tables 1 to 14. In some embodiments, a peptide comprises a neoepitope sequence comprising at least one mutant amino acid (underlined amino acid) as depicted in Tables 1 to 14. In some embodiments, a peptide comprises a neoepitope sequence comprising at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more mutant amino acids (underlined amino acids) as depicted in Tables 1 to 14. In some embodiments, a peptide comprises a neoepitope sequence comprising at least one mutant amino acid (underlined amino acid) and at least one bolded amino acid as depicted in Tables 1 to 14. In some embodiments, a peptide comprises a neoepitope sequence derived from a protein comprising at least one mutant amino acid (underlined amino acid) and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more non-mutant amino acids as depicted in Tables 1 to 14. In some embodiments, a peptide comprises a neoepitope sequence derived from a protein comprising at least one mutant amino acid (underlined amino acid) and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more non-mutant amino acids upstream of the least one mutant amino acid as depicted in Tables 1 to 14. In some embodiments, a peptide comprises a neoepitope sequence derived from a protein comprising at least one mutant amino acid (underlined amino acid) and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more non-mutant amino acids downstream of the least one mutant amino acid as depicted in Tables 1 to 14. In some embodiments, a peptide comprises a neoepitope sequence derived from a protein comprising at least one mutant amino acid (underlined amino acid), at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more non-mutant amino acids upstream of the least one mutant amino acid, and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more non-mutant amino acids downstream of the least one mutant amino acid as depicted in Tables 1 to 14.

In some embodiments, a peptide comprises a neoepitope sequence derived from a protein comprising at least one mutant amino acid and a sequence upstream of the least one mutant amino acid with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence. In some embodiments, a peptide comprises a neoepitope sequence derived from a protein comprising at least one mutant amino acid and a sequence downstream of the least one mutant amino acid with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence. In some embodiments, a peptide comprises a neoepitope sequence derived from a protein comprising at least one mutant amino acid, a sequence upstream of the least one mutant amino acid with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence, and a sequence downstream of the least one mutant amino acid with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence.

In some embodiments, a peptide comprises a neoepitope sequence derived from a protein comprising at least one mutant amino acid and a sequence upstream of the least one mutant amino acid comprising least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence. In some embodiments, a peptide comprises a neoepitope sequence derived from a protein comprising at least one mutant amino acid and a sequence downstream of the least one mutant amino acid comprising least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence. In some embodiments, a peptide comprises a neoepitope sequence derived from a protein comprising at least one mutant amino acid, a sequence upstream of the least one mutant amino acid comprising least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence, and a sequence downstream of the least one mutant amino acid comprising least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence.

In some embodiments, a peptide comprises a neoepitope sequence derived from a protein comprising at least one mutant amino acid (underlined amino acid) as depicted in Tables 1 to 14 and a sequence upstream of the least one mutant amino acid with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence. In some embodiments, a peptide comprises a neoepitope sequence derived from a protein comprising at least one mutant amino acid (underlined amino acid) as depicted in Tables 1 to 14 and a sequence downstream of the least one mutant amino acid with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence. In some embodiments, a peptide comprises a neoepitope sequence derived from a protein comprising at least one mutant amino acid (underlined amino acid) as depicted in Tables 1 to 14, a sequence upstream of the least one mutant amino acid with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence, and a sequence downstream of the least one mutant amino acid with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence.

In some embodiments, a peptide comprises a neoepitope sequence derived from a protein comprising at least one mutant amino acid (underlined amino acid) as depicted in Tables 1 to 14 and a sequence upstream of the least one mutant amino acid comprising least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence. In some embodiments, a peptide comprises a neoepitope sequence derived from a protein comprising at least one mutant amino acid (underlined amino acid) as depicted in Tables 1 to 14 and a sequence downstream of the least one mutant amino acid comprising least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence. In some embodiments, a peptide comprises a neoepitope sequence derived from a protein comprising at least one mutant amino acid (underlined amino acid) as depicted in Tables 1 to 14, a sequence upstream of the least one mutant amino acid comprising least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence, and a sequence downstream of the least one mutant amino acid comprising least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more contiguous amino acids with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a corresponding wild type sequence.

In some embodiments, a peptide comprising a KRAS G12C mutation comprises a sequence of

```
                                    (SEQ ID NO: 1540)
MTEYKLVVVGACGVGKSALTIQLIQNHFVDEYDPTIEDSYRKQVVIDGE
TC LLDILDTAGQE.
```

In some embodiments, a peptide comprising a KRAS G12 C mutation comprises a neoepitope sequence of

```
                                    (SEQ ID NO: 1541)
                    KLVVVGACGV.
```

In some embodiments, a peptide comprising a KRAS G12 C mutation comprises a neoepitope sequence of

```
                                    (SEQ ID NO: 1542)
                    LVVVGACGV.
```

In some embodiments, a peptide comprising a KRAS G12 C mutation comprises a neoepitope sequence of

```
                                    (SEQ ID NO: 1543)
                    VVGACGVGK.
```

In some embodiments, a peptide comprising a KRAS G12 C mutation comprise a neoepitope sequence of

```
                                    (SEQ ID NO: 1544)
                    VVVGACGVGK.
```

In some embodiments, a peptide comprising a KRAS G12D mutation comprises a sequence of

```
                                    (SEQ ID NO: 1545)
MTEYKLVVVGADGVGKSALTIQLIQNHFVDEYDPTIEDSYRKQVVIDGE
TCLLDILDTAGQE.
```

In some embodiments, a peptide comprising a KRAS G12D mutation comprises a neoepitope sequence of

VVGADGVGK. (SEQ ID NO: 1546)

In some embodiments, a peptide comprising a KRAS G12D mutation comprises a neoepitope sequence of

VVVGADGVGK. (SEQ ID NO: 1547)

In some embodiments, a peptide comprising a KRAS G12D mutation comprises a neoepitope sequence of

KLVVVGADGV. (SEQ ID NO: 1548)

In some embodiments, a peptide comprising a KRAS G12D mutation comprises a neoepitope sequence of

LVVVGADGV. (SEQ ID NO: 1549)

In some embodiments, a peptide comprising a KRAS G12V mutation comprises a sequence of MTEYKLVVVGAVGVGKSALTIQLIQNHFVDEYDPTIEDSYRKQVVIDGETCLLDILDTAGQE. (SEQ ID NO: 1550)

In some embodiments, a peptide comprising a KRAS G12V mutation comprises a neoepitope sequence of

KLVVVGAVGV. (SEQ ID NO: 1551)

In some embodiments, a peptide comprising a KRAS G12V mutation comprises a neoepitope sequence of

LVVVGAVGV. (SEQ ID NO: 1552)

In some embodiments, a peptide comprising a KRAS G12V mutation comprises a neoepitope sequence of

VVGAVGVGK. (SEQ ID NO: 1553)

In some embodiments, a peptide comprising a KRAS G12V mutation comprises a neoepitope sequence of

VVVGAVGVGK. (SEQ ID NO: 1554)

In some embodiments, a peptide comprising a KRAS Q61H mutation comprises a sequence of AGGVGKSALTIQLIQNHFVDEYDPTIEDSYRKQVVIDGETCLLDILDTAGHEEYSAMRDQYMRTGEGFLCVFAINNTKSFEDIHHYREQIKRVKDSEDVPM. (SEQ ID NO: 1555)

In some embodiments, a peptide comprising a KRAS Q61H mutation comprises a neoepitope sequence of ILDTAGHEEY (SEQ ID NO: 1556).

In some embodiments, a peptide comprising a KRAS Q61L mutation comprises a sequence of AGGVGKSALTIQLIQNHFVDEYDPTIEDSYRKQVVIDGETCLLDILDTAGLEEYSAMRDQYMRTGEGFLCVFAINNTKSFEDIHHYREQIKRVKDSEDVPM. (SEQ ID NO: 1557)

In some embodiments, a peptide comprising a KRAS Q61L mutation comprises a neoepitope sequence of ILDTAGLEEY (SEQ ID NO: 1558). In some embodiments, a peptide comprising a KRAS Q61L mutation comprises a neoepitope sequence of

LLDILDTAGL. (SEQ ID NO: 1559)

In some embodiments, a peptide comprising a NRAS Q61K mutation comprises a sequence of AGGVGKSALTIQLIQNHFVDEYDPTIEDSYRKQVVIDGETCLLDILDTAGKEEYSAMRDQYMRTGEGFLCVFAINNSKSFADINLYREQIKRVKDSDDVPM. (SEQ ID NO: 1560)

In some embodiments, a peptide comprising a NRAS Q61K mutation comprises a neoepitope sequence of

ILDTAGKEEY. (SEQ ID NO: 1561)

In some embodiments, a peptide comprising a NRAS Q61R mutation comprises a sequence of AGGVGKSALTIQLIQNHFVDEYDPTIEDSYRKQVVIDGETCLLDILDTAGREEYSAMRDQYMRTGEGFLCVFAINNSKSFADINLYREQIKRVKDSDDVPM. (SEQ ID NO: 1562)

In some embodiments, a peptide comprising a NRAS Q61R mutation comprises a neoepitope sequence of

ILDTAGREEY. (SEQ ID NO: 1563)

In some embodiments, a peptide comprising a mutation of a TMPRSS2:ERG fusion comprises a neoepitope sequence of MALNS::EALSVVSEDQSLFECAYGTPHLAKTEMTASSSSDYGQTSKMSPRVPQQDWALNSEALSV. (SEQ ID NO: 1564)

In some embodiments, a peptide comprising a mutation of a TMPRSS2:ERG fusion comprises a neoepitope sequence of

ALNSEALSVV. (SEQ ID NO: 1565)

In some embodiments, a peptide comprising a mutation of a TMPRSS2:ERG fusion comprises a neoepitope sequence of MALNSEALSV (SEQ ID NO: 1566). In some embodiments, a peptide comprising a RAS Q61H mutation comprises a sequence of

TCLLDILDTAGHEEYSAMRDQYM. (SEQ ID NO: 1567)

In some embodiments, a peptide comprising a RAS Q61H mutation comprises a sequence provided in Table 3. In some embodiments, a peptide sequence provided in Table 3 binds to or is predicted to bind to a protein encoded by an HLA allele, which allele is provided in a corresponding column in Table 3 next to the peptide sequence.

TABLE 3

Peptide Sequences Comprising RAS Q61H Mutation, Corresponding HLA Allele, and Rank of Binding Potential

| SEQ ID NO: | Peptide | Allele | Rank of Binding Potential |
|---|---|---|---|
| 1568 | ILDTAGHEEY | HLA-A36:01 | 1 |
| 1569 | ILDTAGHEEY | HLA-A01:01 | 2 |
| 1570 | DTAGHEEYSAM | HLA-A26:01 | 3 |
| 1571 | DTAGHEEYSAM | HLA-A25:01 | 4 |
| 1572 | GHEEYSAM | HLA-B15:09 | 4 |
| 1573 | DTAGHEEY | HLA-A26:01 | 5 |
| 1574 | ILDTAGHEE | HLA-C08:02 | 5 |
| 1575 | AGHEEYSAM | HLA-C01:02 | 6 |
| 1576 | AGHEEYSAM | HLA-B46:01 | 6 |
| 1577 | DTAGHEEY | HLA-A25:01 | 6 |
| 1578 | DTAGHEEY | HLA-A01:01 | 6 |
| 1579 | DTAGHEEY | HLA-B18:01 | 7 |
| 1580 | DTAGHEEY | HLA-A36:01 | 7 |
| 1581 | ILDTAGHEE | HLA-C05:01 | 7 |
| 1582 | ILDTAGHEE | HLA-A02:07 | 7 |
| 1583 | ILDTAGHEEY | HLA-A29:02 | 7 |
| 1584 | ILDTAGHEEY | HLA-C08:02 | 7 |
| 1585 | HEEYSAMRD | HLA-B49:01 | 8 |
| 1586 | TAGHEEYSA | HLA-B35:03 | 8 |
| 1587 | DTAGHEEYS | HLA-A68:02 | 9 |
| 1588 | DTAGHEEYSAMR | HLA-A68:01 | 9 |
| 1589 | GHEEYSAM | HLA-B39:01 | 9 |
| 1590 | ILDTAGHEE | HLA-A01:01 | 9 |
| 1591 | LDTAGHEEY | HLA-B53:01 | 9 |
| 1592 | HEEYSAMRD | HLA-B41:01 | 10 |
| 1593 | ILDTAGHEE | HLA-A36:01 | 10 |
| 1594 | DTAGHEEY | HLA-B58:01 | 11 |
| 1595 | LLDILDTAGH | HLA-A01:01 | 12 |
| 1596 | TAGHEEYSAM | HLA-B35:03 | 12 |
| 1597 | LDTAGHEEY | HLA-B35:01 | 13 |
| 1598 | DILDTAGHE | HLA-A26:01 | 14 |
| 1599 | DTAGHEEY | HLA-C12:03 | 14 |
| 1600 | ILDTAGHEEY | HLA-C05:01 | 14 |
| 1601 | AGHEEYSAM | HLA-A30:02 | 15 |
| 1602 | DILDTAGHEEY | HLA-A25:01 | 15 |
| 1603 | DTAGHEEY | HLA-C02:02 | 15 |
| 1604 | ILDTAGHEE | HLA-C04:01 | 15 |
| 1605 | DILDTAGH | HLA-A26:01 | 16 |
| 1606 | ILDTAGHEE | HLA-A02:01 | 16 |
| 1607 | LDTAGHEEY | HLA-A29:02 | 16 |
| 1608 | ILDTAGHE | HLA-A01:01 | 17 |
| 1609 | LDTAGHEEY | HLA-B18:01 | 17 |
| 1610 | AGHEEYSAM | HLA-C14:03 | 18 |
| 1611 | DILDTAGHEEY | HLA-A29:02 | 18 |
| 1612 | DTAGHEEYS | HLA-A26:01 | 18 |
| 1613 | ILDTAGHEEY | HLA-B15:01 | 18 |
| 1614 | DTAGHEEYSA | HLA-A68:02 | 19 |
| 1615 | ILDTAGHE | HLA-C05:01 | 19 |
| 1616 | ILDTAGHEEY | HLA-A02:07 | 19 |
| 1617 | ILDTAGHEEY | HLA-A30:02 | 19 |
| 1618 | LDTAGHEEY | HLA-A36:01 | 19 |
| 1619 | AGHEEYSAM | HLA-C14:02 | 20 |
| 1620 | AGHEEYSAM | HLA-B15:03 | 20 |
| 1621 | LLDILDTAGH | HLA-A02:07 | 20 |

In some embodiments, a peptide comprising a RAS Q61R mutation comprises a sequence of (SEQ ID NO: 1622)
TCLLDILDTAGREEYSAMRDQYM.

In some embodiments, a peptide comprising a RAS Q61R mutation comprises a sequence provided in Table 4. In some embodiments, a peptide sequence provided in Table 4 binds to or is predicted to bind to a protein encoded by an HLA allele, which allele is provided in a corresponding column in Table 4 next to the peptide sequence.

TABLE 4

Peptide Sequences Comprising RAS Q61R Mutation, Corresponding HLA Allele, and Rank of Binding Potential

| SEQ ID NO: | Peptide | Allele | Rank of Binding Potential |
| --- | --- | --- | --- |
| 1623 | ILDTAGREEY | HLA-A36:01 | 1 |
| 1624 | ILDTAGREEY | HLA-A01:01 | 2 |
| 1625 | DTAGREEYSAM | HLA-A26:01 | 3 |
| 1626 | DILDTAGR | HLA-A33:03 | 4 |
| 1627 | DILDTAGR | HLA-A68:01 | 5 |
| 1628 | DTAGREEY | HLA-A26:01 | 6 |
| 1629 | DTAGREEYSAM | HLA-A25:01 | 6 |
| 1630 | CLLDILDTAGR | HLA-A74:01 | 7 |
| 1631 | DTAGREEY | HLA-A01:01 | 7 |
| 1632 | REEYSAMRD | HLA-B41:01 | 7 |
| 1633 | GREEYSAMR | HLA-B27:05 | 8 |
| 1634 | ILDTAGREE | HLA-C08:02 | 8 |
| 1635 | ILDTAGREEY | HLA-A29:02 | 8 |
| 1636 | REEYSAMRD | HLA-B49:01 | 8 |
| 1637 | AGREEYSAM | HLA-B46:01 | 9 |
| 1638 | DTAGREEY | HLA-B18:01 | 9 |
| 1639 | DTAGREEY | HLA-A25:01 | 9 |
| 1640 | DTAGREEY | HLA-A36:01 | 9 |
| 1641 | DILDTAGR | HLA-A74:01 | 10 |
| 1642 | DILDTAGRE | HLA-A26:01 | 10 |
| 1643 | ILDTAGREE | HLA-C05:01 | 10 |
| 1644 | DILDTAGR | HLA-A26:01 | 11 |
| 1645 | GREEYSAM | HLA-B39:01 | 11 |
| 1646 | AGREEYSAM | HLA-B15:03 | 12 |
| 1647 | GREEYSAM | HLA-C07:02 | 12 |
| 1648 | ILDTAGREE | HLA-A01:01 | 12 |
| 1649 | TAGREEYSA | HLA-B35:03 | 12 |
| 1650 | ILDTAGREEY | HLA-A30:02 | 13 |
| 1651 | DTAGREEYS | HLA-A68:02 | 14 |
| 1652 | ILDTAGRE | HLA-A01:01 | 14 |
| 1653 | CLLDILDTAGR | HLA-A31:01 | 15 |
| 1654 | DTAGREEYSAMR | HLA-A68:01 | 15 |
| 1655 | LLDILDTAGR | HLA-A01:01 | 15 |
| 1656 | DTAGREEY | HLA-B58:01 | 16 |
| 1657 | ILDTAGREEY | HLA-C08:02 | 16 |
| 1658 | DILDTAGR | HLA-A31:01 | 17 |
| 1659 | ILDTAGREE | HLA-C04:01 | 17 |
| 1660 | ILDTAGREEY | HLA-A32:01 | 17 |
| 1661 | LLDILDTAGR | HLA-A74:01 | 17 |
| 1662 | TAGREEYSAM | HLA-B35:03 | 17 |
| 1663 | DILDTAGREEY | HLA-A32:01 | 18 |
| 1664 | ILDTAGRE | HLA-C05:01 | 18 |
| 1665 | ILDTAGREE | HLA-A02:07 | 18 |
| 1666 | REEYSAMRD | HLA-B40:01 | 18 |
| 1667 | AGREEYSAM | HLA-B15:01 | 19 |
| 1668 | AGREEYSAMR | HLA-A31:01 | 19 |
| 1669 | ILDTAGRE | HLA-A36:01 | 19 |
| 1670 | LDILDTAGR | HLA-A68:01 | 19 |
| 1671 | LDTAGREEY | HLA-A29:02 | 19 |
| 1672 | LDTAGREEY | HLA-B35:01 | 19 |
| 1673 | REEYSAMRD | HLA-B45:01 | 19 |
| 1674 | REEYSAMRDQY | HLA-A36:01 | 19 |
| 1675 | DTAGREEY | HLA-C02:02 | 20 |

In some embodiments, a peptide comprising a RAS Q61K mutation comprises a sequence of (SEQ ID NO: 1676)
TCLLDILDTAGKEEYSAMRDQYM.

In a peptide comprising a RAS Q61K mutation comprises a sequence provided in Table 5. In some embodiments, a peptide sequence provided in Table 5 binds to or is predicted to bind to a protein encoded by an HLA allele, which allele is provided in a corresponding column in Table 5 next to the peptide sequence.

TABLE 5

Peptide Sequences Comprising RAS Q61K Mutation, Corresponding HLA Allele, and Rank of Binding Potential

| SEQ ID NO: | Peptide | Allele | Rank of Binding Potential |
|---|---|---|---|
| 1677 | ILDTAGKEEY | HLA-A36:01 | 1 |
| 1678 | ILDTAGKEEY | HLA-A01:01 | 2 |
| 1679 | DTAGKEEYSAM | HLA-A26:01 | 3 |
| 1680 | CLLDILDTAGK | HLA-A03:01 | 4 |
| 1681 | DTAGKEEY | HLA-A01:01 | 5 |
| 1682 | DTAGKEEY | HLA-A26:01 | 5 |
| 1683 | DTAGKEEYSAM | HLA-A25:01 | 5 |
| 1684 | AGKEEYSAM | HLA-B46:01 | 6 |
| 1685 | DILDTAGKE | HLA-A26:01 | 7 |
| 1686 | KEEYSAMRD | HLA-B41:01 | 7 |
| 1687 | DTAGKEEY | HLA-B18:01 | 8 |
| 1688 | GKEEYSAM | HLA-B15:03 | 8 |
| 1689 | ILDTAGKEE | HLA-C08:02 | 8 |
| 1690 | ILDTAGKEEY | HLA-A29:02 | 8 |
| 1691 | DTAGKEEYS | HLA-A68:02 | 9 |
| 1692 | LDTAGKEEY | HLA-B53:01 | 9 |
| 1693 | TAGKEEYSA | HLA-B35:03 | 9 |
| 1694 | DILDTAGK | HLA-A68:01 | 10 |
| 1695 | DTAGKEEY | HLA-A36:01 | 10 |
| 1696 | KEEYSAMRD | HLA-B49:01 | 10 |
| 1697 | LDTAGKEEY | HLA-C07:01 | 10 |
| 1698 | DTAGKEEYSAMR | HLA-A68:01 | 11 |
| 1699 | ILDTAGKEE | HLA-C05:01 | 11 |
| 1700 | ILDTAGKEEY | HLA-C08:02 | 11 |
| 1701 | LLDILDTAGK | HLA-A01:01 | 12 |
| 1702 | AGKEEYSAM | HLA-A30:02 | 13 |
| 1703 | DTAGKEEY | HLA-A25:01 | 13 |
| 1704 | DTAGKEEYS | HLA-A26:01 | 13 |
| 1705 | ILDTAGKE | HLA-C05:01 | 13 |
| 1706 | LDTAGKEEY | HLA-B35:01 | 13 |
| 1707 | AGKEEYSAMR | HLA-A31:01 | 14 |
| 1708 | DILDTAGK | HLA-A33:03 | 14 |
| 1709 | ILDTAGKE | HLA-A01:01 | 14 |
| 1710 | ILDTAGKEE | HLA-A01:01 | 14 |
| 1711 | ILDTAGKEE | HLA-A02:07 | 14 |
| 1712 | TAGKEEYSAM | HLA-B35:03 | 14 |
| 1713 | AGKEEYSAM | HLA-B15:01 | 15 |
| 1714 | ILDTAGKEEY | HLA-A30:02 | 15 |
| 1715 | LDTAGKEEY | HLA-B46:01 | 15 |
| 1716 | DTAGKEEY | HLA-B58:01 | 16 |
| 1717 | ILDTAGKEEY | HLA-C05:01 | 17 |
| 1718 | AGKEEYSAM | HLA-A30:01 | 18 |
| 1719 | AGKEEYSAM | HLA-B15:03 | 18 |
| 1720 | DTAGKEEY | HLA-C02:02 | 18 |
| 1721 | LDTAGKEEY | HLA-A29:02 | 18 |

In some embodiments, a peptide comprising a RAS Q61L mutation comprises a sequence of

TCLLDILDTAGLEEYSAMRDQYM. (SEQ ID NO: 1722)

In some embodiments, a peptide comprising a provided in Table 6 binds to or is predicted to bind to a protein encoded by an HLA allele, which allele is provided in a corresponding column in Table 6 next to the peptide sequence.

TABLE 6

Peptide Sequences Comprising RAS Q61L Mutation, Corresponding HLA Allele, and Rank of Binding Potential

| SEQ ID NO: | Peptide | Allele | Rank of Binding Potential |
|---|---|---|---|
| 1723 | ILDTAGLEEY | HLA-A36:01 | 1 |
| 1724 | ILDTAGLEEY | HLA-A01:01 | 2 |
| 1725 | LLDILDTAGL | HLA-A02:07 | 3 |
| 1726 | GLEEYSAMRDQY | HLA-A36:01 | 4 |
| 1727 | DTAGLEEY | HLA-A25:01 | 5 |
| 1728 | DTAGLEEY | HLA-A26:01 | 5 |
| 1729 | DTAGLEEYSAM | HLA-A26:01 | 5 |
| 1730 | DTAGLEEY | HLA-A01:01 | 6 |
| 1731 | ILDTAGLEE | HLA-C08:02 | 6 |
| 1732 | ILDTAGLEE | HLA-A01:01 | 6 |
| 1733 | CLLDILDTAGL | HLA-A02:04 | 7 |
| 1734 | ILDTAGLEE | HLA-A36:01 | 7 |
| 1735 | LLDILDTAGL | HLA-A01:01 | 7 |
| 1736 | DILDTAGL | HLA-B14:02 | 8 |
| 1737 | DILDTAGLEEY | HLA-A25:01 | 8 |

TABLE 6-continued

Peptide Sequences Comprising RAS Q61L Mutation, Corresponding HLA Allele, and Rank of Binding Potential

| SEQ ID NO: | Peptide | Allele | Rank of Binding Potential |
|---|---|---|---|
| 1738 | DTAGLEEYS | HLA-A68:02 | 8 |
| 1739 | DTAGLEEYSAM | HLA-A25:01 | 8 |
| 1740 | GLEEYSAMR | HLA-A74:01 | 8 |
| 1741 | ILDTAGLE | HLA-A01:01 | 8 |
| 1742 | DILDTAGLEEY | HLA-A26:01 | 9 |
| 1743 | DTAGLEEY | HLA-A36:01 | 9 |
| 1744 | ILDTAGLEEY | HLA-A29:02 | 9 |
| 1745 | DILDTAGL | HLA-B08:01 | 10 |
| 1746 | DTAGLEEY | HLA-B18:01 | 10 |
| 1747 | ILDTAGLEE | HLA-A02:07 | 10 |
| 1748 | LDTAGLEEY | HLA-B35:01 | 10 |
| 1749 | CLLDILDTAGL | HLA-A02:01 | 11 |
| 1750 | DTAGLEEY | HLA-C02:02 | 11 |
| 1751 | ILDTAGLEE | HLA-C05:01 | 11 |
| 1752 | ILDTAGLEEY | HLA-C08:02 | 11 |
| 1753 | ILDTAGLEEY | HLA-A02:07 | 11 |
| 1754 | LLDILDTAGL | HLA-C08:02 | 11 |
| 1755 | DILDTAGL | HLA-A26:01 | 12 |
| 1756 | LDTAGLEEY | HLA-B53:01 | 12 |
| 1757 | DTAGLEEY | HLA-C03:02 | 13 |
| 1758 | DTAGLEEY | HLA-B58:01 | 13 |
| 1759 | ILDTAGLEEY | HLA-A30:02 | 13 |
| 1760 | LLDILDTAGL | HLA-C05:01 | 13 |
| 1761 | LLDILDTAGL | HLA-C04:01 | 13 |
| 1762 | DTAGLEEYSAMR | HLA-A68:01 | 14 |
| 1763 | ILDTAGLE | HLA-A36:01 | 15 |
| 1764 | LLDILDTAGL | HLA-A02:01 | 15 |
| 1765 | AGLEEYSAM | HLA-B15:03 | 16 |
| 1766 | DTAGLEEYSA | HLA-A68:02 | 16 |
| 1767 | GLEEYSAMRDQY | HLA-A01:01 | 16 |
| 1768 | ILDTAGLE | HLA-C04:01 | 16 |
| 1769 | ILDTAGLEEY | HLA-B15:01 | 16 |
| 1770 | LDILDTAGL | HLA-B37:01 | 16 |
| 1771 | AGLEEYSAM | HLA-A30:02 | 17 |
| 1772 | AGLEEYSAM | HLA-B48:01 | 17 |
| 1773 | AGLEEYSAMR | HLA-A31:01 | 17 |
| 1774 | ILDTAGLEE | HLA-C04:01 | 17 |
| 1775 | LDTAGLEEY | HLA-C03:02 | 17 |
| 1776 | AGLEEYSAM | HLA-C14:02 | 18 |
| 1777 | GLEEYSAMR | HLA-A31:01 | 18 |
| 1778 | LEEYSAMRD | HLA-B41:01 | 18 |
| 1779 | LLDILDTAGLE | HLA-A01:01 | 18 |
| 1780 | AGLEEYSAM | HLA-C14:03 | 19 |
| 1781 | LDILDTAGL | HLA-B40:02 | 19 |
| 1782 | LDTAGLEEY | HLA-A29:02 | 19 |
| 1783 | DILDTAGLE | HLA-A26:01 | 20 |
| 1784 | DTAGLEEY | HLA-B15:01 | 20 |
| 1785 | ILDTAGLEEY | HLA-A02:01 | 20 |
| 1786 | LDTAGLEEY | HLA-A36:01 | 20 |
| 1787 | LDTAGLEEY | HLA-B46:01 | 20 |
| 1788 | DTAGLEEY | HLA-A68:02 | 21 |
| 1789 | DTAGLEEY | HLA-C12:03 | 21 |
| 1790 | ILDTAGLE | HLA-C05:01 | 21 |
| 1791 | LDTAGLEEY | HLA-B18:01 | 21 |
| 1792 | LEEYSAMRD | HLA-B49:01 | 21 |
| 1793 | TAGLEEYSA | HLA-B54:01 | 21 |
| 1794 | DILDTAGLEEY | HLA-A29:02 | 22 |
| 1795 | GLEEYSAM | HLA-C05:01 | 22 |

In some embodiments, a peptide comprising a RAS G12A mutation comprises a sequence of

```
                                    (SEQ ID NO: 1796)
MTEYKLVVVGAAGVGKSALTIQL.
```

In some embodiments a peptide comprising a RAS G12A mutation comprises a sequence provided in Table 7. In some embodiments, a peptide sequence provided in Table 7 binds to or is predicted to bind to a protein encoded by an HLA allele, which allele is provided in a corresponding column in Table 7 next to the peptide sequence.

TABLE 7

Peptide Sequences Comprising RAS G12A Mutation, Corresponding HLA Allele, and Rank of Binding Potential

| SEQ ID NO: | Peptide | Allele | Rank of Binding Potential |
|---|---|---|---|
| 1797 | AAGVGKSAL | HLA-C03:04 | 1 |
| 1798 | VVVGAAGVGK | HLA-A11:01 | 1 |
| 1799 | VVGAAGVGK | HLA-A11:01 | 2 |
| 1800 | TEYKLVVVGAA | HLA-B50:01 | 3 |
| 1801 | VVGAAGVGK | HLA-A03:01 | 3 |
| 1802 | VVVGAAGVGK | HLA-A68:01 | 3 |
| 1803 | AAGVGKSAL | HLA-C08:02 | 4 |
| 1804 | AAGVGKSAL | HLA-C08:01 | 4 |
| 1805 | AAGVGKSAL | HLA-B46:01 | 4 |
| 1806 | AAGVGKSAL | HLA-B81:01 | 5 |
| 1807 | GAAGVGKSAL | HLA-B48:01 | 5 |
| 1808 | LVVVGAAGV | HLA-A68:02 | 5 |
| 1809 | AAGVGKSAL | HLA-C03:04 | 1 |
| 1810 | VVVGAAGVGK | HLA-A11:01 | 1 |
| 1811 | VVGAAGVGK | HLA-A11:01 | 2 |
| 1812 | TEYKLVVVGAA | HLA-B50:01 | 3 |
| 1813 | VVGAAGVGK | HLA-A03:01 | 3 |
| 1814 | VVVGAAGVGK | HLA-A68:01 | 3 |
| 1815 | AAGVGKSAL | HLA-C08:02 | 4 |
| 1816 | AAGVGKSAL | HLA-C08:01 | 4 |
| 1817 | AAGVGKSAL | HLA-B46:01 | 4 |
| 1818 | AAGVGKSAL | HLA-B81:01 | 5 |
| 1819 | AAGVGKSAL | HLA-C03:02 | 5 |
| 1820 | AAGVGKSAL | HLA-C01:02 | |
| 1821 | GAAGVGKSAL | HLA-B48:01 | 5 |
| 1822 | LVVVGAAGV | HLA-A68:02 | 5 |
| 1823 | AAGVGKSAL | HLA-C03:03 | 6 |
| 1824 | VVGAAGVGK | HLA-A68:01 | 6 |
| 1825 | GAAGVGKSAL | HLA-B81:01 | 7 |
| 1826 | VVVGAAGVGK | HLA-A03:01 | 7 |
| 1827 | AAGVGKSAL | HLA-C05:01 | 8 |
| 1828 | AAGVGKSAL | HLA-C12:03 | 8 |
| 1829 | GAAGVGKSA | HLA-B46:01 | 8 |
| 1830 | VVGAAGVGK | HLA-A30:01 | 8 |
| 1831 | GAAGVGKSA | HLA-B55:01 | 9 |
| 1832 | KLVVVGAAGV | HLA-A02:01 | 9 |
| 1833 | AGVGKSAL | HLA-B08:01 | 10 |
| 1834 | GAAGVGKSAL | HLA-C03:04 | 10 |
| 1835 | AAGVGKSAL | HLA-C17:01 | 11 |
| 1836 | GAAGVGKSAL | HLA-C03:03 | 11 |
| 1837 | VVVGAAGV | HLA-A68:02 | 11 |
| 1838 | YKLVVVGAA | HLA-B54:01 | 11 |
| 1839 | AAGVGKSAL | HLA-B48:01 | 12 |
| 1840 | AGVGKSAL | HLA-C03:04 | 12 |
| 1841 | AGVGKSAL | HLA-C07:01 | 12 |
| 1842 | VVVGAAGVGK | HLA-A30:01 | 12 |
| 1843 | AAGVGKSA | HLA-B46:01 | 13 |
| 1844 | KLVVVGAAGV | HLA-A02:07 | 13 |
| 1845 | YKLVVVGAA | HLA-B50:01 | 13 |
| 1846 | AAGVGKSAL | HLA-B07:02 | 14 |
| 1847 | GAAGVGKSAL | HLA-A68:02 | 14 |
| 1848 | VVGAAGVGK | HLA-A74:01 | 14 |
| 1849 | AGVGKSAL | HLA-C08:01 | 15 |
| 1850 | GAAGVGKSAL | HLA-C17:01 | 15 |
| 1851 | GAAGVGKSAL | HLA-C08:01 | 16 |
| 1852 | GAAGVGKSAL | HLA-B35:03 | 16 |
| 1853 | AAGVGKSAL | HLA-C02:02 | 17 |
| 1854 | AAGVGKSAL | HLA-B35:03 | 17 |
| 1855 | AAGVGKSAL | HLA-C12:02 | 17 |
| 1856 | AAGVGKSAL | HLA-C14:03 | 17 |
| 1857 | GAAGVGKSA | HLA-B50:01 | 17 |
| 1858 | AGVGKSAL | HLA-C03:02 | 18 |
| 1859 | GAAGVGKSA | HLA-C03:04 | 18 |
| 1860 | LVVVGAAGV | HLA-B55:01 | 18 |
| 1861 | TEYKLVVVGAA | HLA-B41:01 | 18 |
| 1862 | AGVGKSAL | HLA-C01:02 | 19 |
| 1863 | GAAGVGKSA | HLA-B54:01 | 19 |
| 1864 | GAAGVGKSAL | HLA-B07:02 | 19 |
| 1865 | VGAAGVGKSA | HLA-B55:01 | 19 |
| 1866 | AGVGKSAL | HLA-B48:01 | 20 |
| 1867 | AGVGKSALTI | HLA-B49:01 | 20 |
| 1868 | VVVGAAGV | HLA-B55:01 | 20 |

In some embodiments, a peptide comprising a RAS G12C mutation comprises a sequence of (SEQ ID NO: 1869)
MTEYKLVVVGACGVGKSALTIQL.

In some embodiments, a peptide comprising a RAS G12C mutation comprises a sequence provided in Table 8. In some embodiments, a peptide sequence provided in Table 8 binds to or is predicted to bind to a protein encoded by an HLA allele, which allele is provided in a corresponding column in Table 8 next to the peptide sequence.

TABLE 8

Peptide Sequences Comprising RAS G12C Mutation, Corresponding HLA Allele, and Rank of Binding Potential

| SEQ ID NO: | Peptide | Allele | Rank of Binding Potential |
|---|---|---|---|
| 1870 | VVVGACGVGK | HLA-A11:01 | 1 |
| 1871 | VVGACGVGK | HLA-A03:01 | 2 |
| 1872 | VVGACGVGK | HLA-A11:01 | 3 |
| 1873 | VVVGACGVGK | HLA-A68:01 | 4 |
| 1874 | VVGACGVGK | HLA-A68:01 | 5 |
| 1875 | VVVGACGVGK | HLA-A03:01 | 5 |
| 1876 | VVGACGVGK | HLA-A30:01 | 6 |
| 1877 | ACGVGKSAL | HLA-B81:01 | 7 |
| 1878 | ACGVGKSAL | HLA-C01:02 | 7 |
| 1879 | ACGVGKSAL | HLA-C14:03 | 8 |
| 1880 | ACGVGKSAL | HLA-C03:04 | 9 |
| 1881 | VVVGACGVGK | HLA-A30:01 | 9 |
| 1882 | ACGVGKSAL | HLA-C14:02 | 10 |
| 1883 | CGVGKSAL | HLA-B08:01 | 10 |
| 1884 | KLVVVGACGV | HLA-A02:01 | 10 |
| 1885 | ACGVGKSAL | HLA-B07:02 | 11 |
| 1886 | GACGVGKSAL | HLA-B48:01 | 12 |
| 1887 | GACGVGKSAL | HLA-C03:03 | 13 |
| 1888 | ACGVGKSAL | HLA-B48:01 | 14 |
| 1889 | ACGVGKSAL | HLA-B40:01 | 14 |
| 1890 | YKLVVVGAC | HLA-B48:01 | 14 |
| 1891 | YKLVVVGAC | HLA-B15:03 | 14 |
| 1892 | GACGVGKSA | HLA-B46:01 | 15 |
| 1893 | GACGVGKSAL | HLA-C03:04 | 15 |
| 1894 | GACGVGKSAL | HLA-C01:02 | 15 |
| 1895 | LVVVGACGV | HLA-A68:02 | 15 |
| 1896 | CGVGKSAL | HLA-C03:04 | 16 |

TABLE 8-continued

Peptide Sequences Comprising RAS G12C Mutation, Corresponding HLA Allele, and Rank of Binding Potential

| SEQ ID NO: | Peptide | Allele | Rank of Binding Potential |
|---|---|---|---|
| 1897 | GACGVGKSAL | HLA-C08:02 | 16 |
| 1898 | VVGACGVGK | HLA-A74:01 | 16 |

In some embodiments, a peptide comprising a RAS G12D mutation comprises a sequence of (SEQ ID NO: 1899)
MTEYKLVVVGADGVGKSALTIQL.

In some embodiments, a peptide comprising a RAS G12D mutation comprises a sequence provided in Table 9. In some embodiments, a peptide sequence provided in Table 9 binds to or is predicted to bind to a protein encoded by an HLA allele, which allele is provided in a corresponding column in Table 9 next to the peptide sequence

TABLE 9

Peptide Sequences Comprising RAS G12D Mutation, Corresponding HLA Allele, and Rank of Binding Potential

| SEQ ID NO: | Peptide | Allele | Rank of Binding Potential |
|---|---|---|---|
| 1900 | GADGVGKSAL | HLA-C08:02 | 1 |
| 1901 | GADGVGKSAL | HLA-C05:01 | 2 |
| 1902 | VVVGADGVGK | HLA-A11:01 | 3 |
| 1903 | DGVGKSAL | HLA-B14:02 | 4 |
| 1904 | VVGADGVGK | HLA-A11:01 | 4 |
| 1905 | VVGADGVGK | HLA-A03:01 | 5 |
| 1906 | DGVGKSAL | HLA-B08:01 | 6 |
| 1907 | VVVGADGVGK | HLA-A68:01 | 6 |
| 1908 | GADGVGKSAL | HLA-C03:03 | 7 |
| 1909 | VVGADGVGK | HLA-A30:01 | 7 |
| 1910 | ADGVGKSAL | HLA-B37:01 | 8 |
| 1911 | GADGVGKSAL | HLA-C08:01 | 8 |
| 1912 | VVGADGVGK | HLA-A68:01 | 8 |
| 1913 | GADGVGKSA | HLA-C08:02 | 9 |
| 1914 | GADGVGKSAL | HLA-B35:03 | 9 |
| 1915 | GADGVGKS | HLA-C05:01 | 10 |
| 1916 | GADGVGKSA | HLA-C05:01 | 10 |
| 1917 | ADGVGKSAL | HLA-C07:01 | 11 |
| 1918 | VVVGADGVGK | HLA-A03:01 | 11 |
| 1919 | ADGVGKSAL | HLA-B40:02 | 12 |

TABLE 9-continued

Peptide Sequences Comprising RAS G12D Mutation, Corresponding HLA Allele, and Rank of Binding Potential

| SEQ ID NO: | Peptide | Allele | Rank of Binding Potential |
|---|---|---|---|
| 1920 | ADGVGKSAL | HLA-B46:01 | 13 |
| 1921 | GADGVGKSAL | HLA-C03:04 | 13 |
| 1922 | ADGVGKSAL | HLA-B81:01 | 14 |
| 1923 | GADGVGKSAL | HLA-C17:01 | 14 |
| 1924 | VVVGADGVGK | HLA-A30:01 | 14 |
| 1925 | GADGVGKSA | HLA-B35:03 | 15 |
| 1926 | GADGVGKSA | HLA-B46:01 | 15 |
| 1927 | GADGVGKSAL | HLA-B48:01 | 15 |
| 1928 | KLVVVGADGV | HLA-A02:01 | 15 |
| 1929 | LVVVGADGV | HLA-A68:02 | 15 |
| 1930 | VGADGVGKSA | HLA-B55:01 | 15 |
| 1931 | VVGADGVGK | HLA-A74:01 | 16 |
| 1932 | GADGVGKSA | HLA-B53:01 | 17 |
| 1933 | KLVVVGADGV | HLA-A02:07 | 17 |
| 1934 | VGADGVGK | HLA-A68:01 | 17 |
| 1935 | YKLVVVGAD | HLA-B48:01 | 17 |
| 1936 | ADGVGKSAL | HLA-C14:03 | 18 |
| 1937 | DGVGKSALTI | HLA-B51:01 | 18 |
| 1938 | VGADGVGK | HLA-A11:01 | 18 |

In some embodiments, a peptide comprising a RAS G12R mutation comprises a sequence of

MTEYKLVVVGARGVGKSALTIQL. (SEQ ID NO: 1939)

In some embodiments a peptide comprising a RAS G12R mutation comprises a sequence provided in Table 10. In some embodiments, a peptide sequence provided in Table 10 binds to or is predicted to bind to a protein encoded by an HLA allele, which allele is provided in a corresponding column in Table 10 next to the peptide sequence.

TABLE 10

Peptide Sequences Comprising RAS G12R Mutation, Corresponding HLA Allele, and Rank of Binding Potential

| SEQ ID NO: | Peptide | Allele | Rank of Binding Potential |
|---|---|---|---|
| 1940 | VVGARGVGK | HLA-A11:01 | 1 |
| 1941 | VVVGARGVGK | HLA-A68:01 | 1 |
| 1942 | GARGVGKSA | HLA-B46:01 | 2 |
| 1943 | ARGVGKSAL | HLA-B27:05 | 3 |
| 1944 | GARGVGKSA | HLA-B55:01 | 3 |
| 1945 | RGVGKSAL | HLA-C07:01 | 4 |
| 1946 | VVGARGVGK | HLA-A30:01 | 5 |
| 1947 | ARGVGKSAL | HLA-B38:01 | 6 |
| 1948 | ARGVGKSAL | HLA-B14:02 | 6 |
| 1949 | VVGARGVGK | HLA-A68:01 | 6 |
| 1950 | VVVGARGVGK | HLA-A03:01 | 7 |
| 1951 | GARGVGKSAL | HLA-B48:01 | 8 |
| 1952 | RGVGKSAL | HLA-B48:01 | 8 |
| 1953 | RGVGKSALTI | HLA-A23:01 | 8 |
| 1954 | ARGVGKSAL | HLA-C06:02 | 9 |
| 1955 | GARGVGKSA | HLA-A30:01 | 9 |
| 1956 | GARGVGKSAL | HLA-B81:01 | 9 |
| 1957 | VVVGARGVGK | HLA-A30:01 | 9 |
| 1958 | GARGVGKSAL | HLA-B07:02 | 10 |
| 1959 | LVVVGARGV | HLA-C06:02 | 10 |
| 1960 | RGVGKSAL | HLA-B81:01 | 10 |
| 1961 | VVGARGVGK | HLA-A74:01 | 11 |
| 1962 | KLVVVGARGV | HLA-A02:01 | 12 |
| 1963 | LVVVGARGV | HLA-B55:01 | 12 |
| 1964 | YKLVVVGAR | HLA-A33:03 | 12 |
| 1965 | KLVVVGAR | HLA-A74:01 | 13 |
| 1966 | KLVVVGARGV | HLA-B13:02 | 13 |
| 1967 | RGVGKSAL | HLA-C01:02 | 13 |
| 1968 | LVVVGARGV | HLA-A68:02 | 14 |
| 1969 | VVVGARGV | HLA-B55:01 | 14 |
| 1970 | ARGVGKSAL | HLA-B15:09 | 15 |
| 1971 | ARGVGKSAL | HLA-C14:03 | 16 |
| 1972 | GARGVGKSA | HLA-B54:01 | 16 |
| 1973 | VVVGARGV | HLA-B52:01 | 16 |

In some embodiments, a peptide comprising a RAS G12S mutation comprises a sequence of

MTEYKLVVVGASGVGKSALTIQL (SEQ ID NO: 1974)

In some embodiments, a peptide comprising a RAS G12S mutation comprises a sequence provided in Table 11. In some embodiments, a peptide sequence provided in Table 11 binds to or is predicted to bind to a protein encoded by an HLA allele, which allele is provided in a corresponding column in Table 11 next to the peptide sequence.

TABLE 11

Peptide Sequences Comprising RAS G12S Mutation, Corresponding HLA Allele, and Rank of Binding Potential

| SEQ ID NO: | Peptide | Allele | Rank of Binding Potential |
| --- | --- | --- | --- |
| 1975 | VVVGASGVGK | HLA-A11:01 | 1 |
| 1976 | VVGASGVGK | HLA-A11:01 | 2 |
| 1977 | VVGASGVGK | HLA-A03:01 | 3 |
| 1978 | VVVGASGVGK | HLA-A68:01 | 4 |
| 1979 | ASGVGKSAL | HLA-C03:04 | 5 |
| 1980 | ASGVGKSAL | HLA-B46:01 | 5 |
| 1981 | VVGASGVGK | HLA-A68:01 | 6 |
| 1982 | VVVGASGVGK | HLA-A03:01 | 6 |
| 1983 | ASGVGKSAL | HLA-C01:02 | 7 |
| 1984 | GASGVGKSAL | HLA-B48:01 | 7 |
| 1985 | ASGVGKSAL | HLA-C07:01 | 8 |
| 1986 | ASGVGKSAL | HLA-C08:02 | 9 |
| 1987 | GASGVGKSAL | HLA-B81:01 | 9 |
| 1988 | SGVGKSAL | HLA-B08:01 | 9 |
| 1989 | ASGVGKSAL | HLA-C03:03 | 10 |
| 1990 | ASGVGKSAL | HLA-C03:02 | 10 |
| 1991 | SGVGKSAL | HLA-B14:02 | 10 |
| 1992 | VVGASGVGK | HLA-A30:01 | 10 |
| 1993 | ASGVGKSAL | HLA-C08:01 | 11 |
| 1994 | VVVGASGVGK | HLA-A30:01 | 11 |
| 1995 | GASGVGKSAL | HLA-B35:03 | 12 |
| 1996 | SGVGKSAL | HLA-C07:01 | 12 |
| 1997 | ASGVGKSAL | HLA-B81:01 | 13 |
| 1998 | GASGVGKSA | HLA-B55:01 | 13 |
| 1999 | GASGVGKSAL | HLA-C03:03 | 13 |
| 2000 | KLVVVGASGV | HLA-A02:01 | 13 |
| 2001 | LVVVGASGV | HLA-A68:02 | 13 |
| 2002 | SGVGKSAL | HLA-C01:02 | 13 |
| 2003 | ASGVGKSA | HLA-B46:01 | 14 |
| 2004 | ASGVGKSAL | HLA-C15:02 | 14 |
| 2005 | GASGVGKSAL | HLA-C08:01 | 15 |
| 2006 | SGVGKSAL | HLA-C03:04 | 15 |
| 2007 | ASGVGKSAL | HLA-C05:01 | 16 |
| 2008 | GASGVGKSAL | HLA-C03:04 | 16 |

TABLE 11-continued

Peptide Sequences Comprising RAS G12S Mutation, Corresponding HLA Allele, and Rank of Binding Potential

| SEQ ID NO: | Peptide | Allele | Rank of Binding Potential |
| --- | --- | --- | --- |
| 2009 | VVGASGVGK | HLA-A74:01 | 16 |
| 2010 | ASGVGKSAL | HLA-B48:01 | 17 |
| 2011 | GASGVGKSAL | HLA-C01:02 | 17 |
| 2012 | SGVGKSAL | HLA-C03:02 | 17 |
| 2013 | SGVGKSALTI | HLA-A23:01 | 17 |
| 2014 | VGASGVGKSA | HLA-B55:01 | 18 |
| 2015 | ASGVGKSAL | HLA-C12:03 | 19 |
| 2016 | ASGVGKSAL | HLA-B57:03 | 19 |
| 2017 | KLVVVGASGV | HLA-A02:07 | 19 |
| 2018 | SGVGKSAL | HLA-B81:01 | 19 |
| 2019 | ASGVGKSAL | HLA-C17:01 | 20 |
| 2020 | KLVVVGASG | HLA-A32:01 | 20 |

In some embodiments, a peptide comprising a RAS G12V mutation comprises a sequence of (SEQ ID NO: 2021)
MTEYKLVVVGAVGVGKSALTIQL.

In some embodiments, a peptide comprising a RAS G12V mutation comprises a sequence provided in Table 12. In some embodiments, a peptide sequence provided in Table 12 binds to or is predicted to bind to a protein encoded by an HLA allele, which allele is provided in a corresponding column in Table 12 next to the peptide sequence.

TABLE 12

Peptide Sequences Comprising RAS G12V Mutation, Corresponding HLA Allele, and Rank of Binding Potential

| SEQ ID NO: | Peptide | Allele | Rank of Binding Potential |
| --- | --- | --- | --- |
| 2022 | VVGAVGVGK | HLA-A03:01 | 1 |
| 2023 | VVGAVGVGK | HLA-A11:01 | 2 |
| 2024 | VVVGAVGVGK | HLA-A11:01 | 2 |
| 2025 | VVVGAVGVGK | HLA-A68:01 | 3 |
| 2026 | VVGAVGVGK | HLA-A68:01 | 4 |
| 2027 | LVVVGAVGV | HLA-A68:02 | 5 |
| 2028 | VVGAVGVGK | HLA-A30:01 | 5 |
| 2029 | AVGVGKSAL | HLA-B81:01 | 6 |
| 2030 | KLVVVGAVGV | HLA-A02:01 | 6 |
| 2031 | AVGVGKSAL | HLA-B46:01 | 7 |

TABLE 12-continued

Peptide Sequences Comprising RAS G12V Mutation, Corresponding HLA Allele, and Rank of Binding Potential

| SEQ ID NO: | Peptide | Allele | Rank of Binding Potential |
|---|---|---|---|
| 2032 | GAVGVGKSAL | HLA-C03:03 | 7 |
| 2033 | GAVGVGKSAL | HLA-B48:01 | 7 |
| 2034 | VVVGAVGVGK | HLA-A03:01 | 7 |
| 2035 | AVGVGKSAL | HLA-C03:04 | 8 |
| 2036 | GAVGVGKSAL | HLA-C03:04 | 8 |
| 2037 | KLVVVGAVGV | HLA-A02:07 | 9 |
| 2038 | VGVGKSAL | HLA-B08:01 | 9 |
| 2039 | VVVGAVGV | HLA-A68:02 | 9 |
| 2040 | AVGVGKSAL | HLA-C08:02 | 10 |
| 2041 | AVGVGKSAL | HLA-B07:02 | 10 |
| 2042 | GAVGVGKSAL | HLA-B35:03 | 10 |
| 2043 | AVGVGKSAL | HLA-C08:01 | 11 |
| 2044 | AVGVGKSAL | HLA-C01:02 | 11 |
| 2045 | GAVGVGKSA | HLA-B55:01 | 11 |
| 2046 | GAVGVGKSAL | HLA-B81:01 | 11 |
| 2047 | GAVGVGKSAL | HLA-C08:01 | 11 |
| 2048 | KLVVVGAVGV | HLA-B13:02 | 11 |
| 2049 | VGVGKSAL | HLA-C03:04 | 11 |
| 2050 | AVGVGKSAL | HLA-A32:01 | 12 |
| 2051 | GAVGVGKSA | HLA-B46:01 | 12 |
| 2052 | VGVGKSAL | HLA-C03:02 | 12 |
| 2053 | VGVGKSALTI | HLA-A23:01 | 12 |
| 2054 | GAVGVGKSA | HLA-B54:01 | 13 |
| 2055 | VGVGKSAL | HLA-C01:02 | 13 |
| 2056 | AVGVGKSAL | HLA-B48:01 | 14 |
| 2057 | AVGVGKSAL | HLA-C03:03 | 14 |
| 2058 | AVGVGKSAL | HLA-B42:01 | 14 |
| 2059 | LVVVGAVGV | HLA-B55:01 | 14 |
| 2060 | VGVGKSAL | HLA-C08:01 | 14 |
| 2061 | VVGAVGVGK | HLA-A74:01 | 14 |
| 2062 | AVGVGKSAL | HLA-C05:01 | 15 |
| 2063 | AVGVGKSAL | HLA-C03:02 | 15 |
| 2064 | GAVGVGKSA | HLA-C03:04 | 15 |
| 2065 | KLVVVGAVGV | HLA-A02:04 | 15 |
| 2066 | LVVVGAVGV | HLA-A02:07 | 15 |
| 2067 | VGVGKSAL | HLA-B14:02 | 15 |
| 2068 | VVVGAVGVGK | HLA-A30:01 | 15 |
| 2069 | VVGAVGVGK | HLA-B81:01 | 16 |
| 2070 | VVVGAVGV | HLA-B55:01 | 16 |
| 2071 | AVGVGKSAL | HLA-C14:03 | 17 |
| 2072 | AVGVGKSAL | HLA-B15:01 | 17 |
| 2073 | LVVVGAVGV | HLA-B54:01 | 17 |
| 2074 | AVGVGKSA | HLA-B55:01 | 18 |
| 2075 | AVGVGKSAL | HLA-C17:01 | 18 |
| 2076 | GAVGVGKSA | HLA-B50:01 | 19 |
| 2077 | GAVGVGKSAL | HLA-C17:01 | 19 |
| 2078 | YKLVVVGAV | HLA-A02:04 | 19 |
| 2079 | GAVGVGKSAL | HLA-B35:01 | 20 |
| 2080 | VVGAVGVGK | HLA-A31:01 | 20 |
| 2081 | YKLVVVGAV | HLA-B51:01 | 20 |

In some embodiments, a peptide comprising a RAS G13C mutation comprises a sequence of (SEQ ID NO: 2082)
MTEYKLVVVGAGCVGKSALTIQL.

In some embodiments, a peptide comprising a RAS G13C mutation comprises a sequence provided in Table 13. In some embodiments, a peptide sequence provided in Table 13 binds to or is predicted to bind to a protein encoded by an HLA allele, which allele is provided in a corresponding column in Table 13 next to the peptide sequence.

TABLE 13

Peptide Sequences Comprising RAS G13C Mutation, Corresponding HLA Allele, and Rank of Binding Potential

| SEQ ID NO: | Peptide | Allele | Rank of Binding Potential |
|---|---|---|---|
| 2083 | VVVGAGCVGK | HLA-A11:01 | 1 |
| 2084 | VVGAGCVGK | HLA-A11:01 | 2 |
| 2085 | AGCVGKSAL | HLA-C01:02 | 3 |
| 2086 | VVGAGCVGK | HLA-A03:01 | 4 |
| 2087 | VVVGAGCVGK | HLA-A68:01 | 4 |
| 2088 | CVGKSALTI | HLA-B13:02 | 5 |
| 2089 | VVGAGCVGK | HLA-A68:01 | 5 |
| 2090 | VVGAGCVGK | HLA-A30:01 | 6 |
| 2091 | AGCVGKSAL | HLA-B48:01 | 7 |

TABLE 13-continued

Peptide Sequences Comprising RAS G13C Mutation, Corresponding HLA Allele, and Rank of Binding Potential

| SEQ ID NO: | Peptide | Allele | Rank of Binding Potential |
|---|---|---|---|
| 2092 | AGCVGKSAL | HLA-C03:04 | 8 |
| 2093 | GCVGKSALTI | HLA-B49:01 | 8 |
| 2094 | AGCVGKSAL | HLA-C08:02 | 9 |
| 2095 | VVVGAGCVGK | HLA-A03:01 | 9 |
| 2096 | KLVVVGAGC | HLA-A30:02 | 10 |
| 2097 | GCVGKSAL | HLA-C07:01 | 11 |
| 2098 | VVGAGCVGK | HLA-A74:01 | 12 |
| 2099 | AGCVGKSAL | HLA-C14:03 | 13 |
| 2100 | KLVVVGAGC | HLA-B15:01 | 14 |

In some embodiments, a peptide comprising a RAS G13D mutation comprises a sequence of (SEQ ID NO: 2101)
MTEYKLVVVGAGDVGKSALTIQL.

In some embodiments, a peptide comprising a RAS G13D mutation comprises a sequence provided in Table 14. In some embodiments, a peptide sequence provided in Table 14 binds to or is predicted to bind to a protein encoded by an HLA allele, which allele is provided in a corresponding column in Table 14 next to the peptide sequence.

TABLE 14

Peptide Sequences Comprising RAS G13D Mutation, Corresponding HLA Allele, and Rank of Binding Potential

| SEQ ID NO: | Peptide | Allele | Rank of Binding Potential |
|---|---|---|---|
| 2102 | AGDVGKSAL | HLA-C08:02 | 1 |
| 2103 | AGDVGKSAL | HLA-C05:01 | 2 |
| 2104 | VVGAGDVGK | HLA-A11:01 | 3 |
| 2105 | VVVGAGDVGK | HLA-A11:01 | 3 |
| 2106 | VVVGAGDVGK | HLA-A68:01 | 4 |
| 2107 | GAGDVGKSA | HLA-B46:01 | 5 |
| 2108 | GAGDVGKSAL | HLA-B48:01 | 5 |
| 2109 | VVGAGDVGK | HLA-A68:01 | 5 |
| 2110 | VVGAGDVGK | HLA-A03:01 | 5 |
| 2111 | AGDVGKSAL | HLA-C03:04 | 6 |
| 2112 | AGDVGKSAL | HLA-C04:01 | 6 |
| 2113 | AGDVGKSAL | HLA-C01:02 | 6 |
| 2114 | DVGKSALTI | HLA-B13:02 | 6 |
| 2115 | DVGKSALTI | HLA-A25:01 | 6 |
| 2116 | GDVGKSAL | HLA-C07:01 | 6 |
| 2117 | GDVGKSAL | HLA-B40:02 | 7 |
| 2118 | GDVGKSAL | HLA-B37:01 | 8 |
| 2119 | AGDVGKSAL | HLA-B48:01 | 9 |
| 2120 | DVGKSALTI | HLA-B51:01 | 10 |
| 2121 | VVGAGDVGK | HLA-A30:01 | 10 |
| 2122 | GAGDVGKSAL | HLA-C08:01 | 11 |
| 2123 | GAGDVGKSAL | HLA-B81:01 | 11 |
| 2124 | AGDVGKSAL | HLA-C08:01 | 12 |
| 2125 | GAGDVGKSAL | HLA-C03:04 | 12 |
| 2126 | DVGKSALTI | HLA-B53:01 | 13 |
| 2127 | AGDVGKSAL | HLA-B07:02 | 14 |
| 2128 | AGDVGKSAL | HLA-B46:01 | 14 |
| 2129 | DVGKSALTI | HLA-A26:01 | 14 |
| 2130 | VVGAGDVGK | HLA-A74:01 | 14 |
| 2131 | GAGDVGKSA | HLA-B54:01 | 15 |
| 2132 | DVGKSALTI | HLA-B38:01 | 16 |
| 2133 | GAGDVGKSAL | HLA-C03:03 | 16 |
| 2134 | VVVGAGDVGK | HLA-A03:01 | 16 |

A. Peptide Modification

In some embodiments, the present disclosure includes modified peptides. A modification can include a covalent chemical modification that does not alter the primary amino acid sequence of the antigenic peptide itself. Modifications can produce peptides with desired properties, for example, prolonging the in vivo half-life, increasing the stability, reducing the clearance, altering the immunogenicity or allergenicity, enabling the raising of particular antibodies, cellular targeting, antigen uptake, antigen processing, HLA affinity, HLA stability or antigen presentation. In some embodiments, a peptide may comprise one or more sequences that enhance processing and presentation of epitopes by APCs, for example, for generation of an immune response.

In some embodiments, the peptide may be modified to provide desired attributes. For instance, the ability of the peptides to induce CTL activity can be enhanced by linkage to a sequence which contains at least one epitope that is capable of inducing a T helper cell response. In some embodiments, immunogenic peptides/T helper conjugates are linked by a spacer molecule. In some embodiments, a spacer comprises relatively small, neutral molecules, such as amino acids or amino acid mimetics, which are substantially uncharged under physiological conditions. Spacers can be selected from, e.g., Ala, Gly, or other neutral spacers of nonpolar amino acids or neutral polar amino acids. It will be understood that the optionally present spacer need not be comprised of the same residues and thus may be a hetero- or homo-oligomer. The neoantigenic peptide may be linked to the T helper peptide either directly or via a spacer either at the amino or carboxy terminus of the peptide. The amino terminus of either the neoantigenic peptide or the T helper peptide may be acylated. Examples of T helper peptides include tetanus toxoid residues 830-843, influenza residues 307-319, and malaria circumsporozoite residues 382-398 and residues 378-389.

The peptide sequences of the present disclosure may optionally be altered through changes at the DNA level, particularly by mutating the DNA encoding the peptide at preselected bases such that codons are generated that will translate into the desired amino acids.

In some embodiments, the peptide described herein can contain substitutions to modify a physical property (e.g., stability or solubility) of the resulting peptide. For example, the peptides can be modified by the substitution of a cysteine (C) with α-amino butyric acid ("B"). Due to its chemical nature, cysteine has the propensity to form disulfide bridges and sufficiently alter the peptide structurally so as to reduce binding capacity. Substituting α-amino butyric acid for C not only alleviates this problem, but actually improves binding and cross-binding capability in certain instances. Substitution of cysteine with α-amino butyric acid can occur at any residue of a neoantigenic peptide, e.g., at either anchor or non-anchor positions of an epitope or analog within a peptide, or at other positions of a peptide.

The peptide may also be modified by extending or decreasing the compound's amino acid sequence, e.g., by the addition or deletion of amino acids. The peptides or analogs can also be modified by altering the order or composition of certain residues. It will be appreciated by the skilled artisan that certain amino acid residues essential for biological activity, e.g., those at critical contact sites or conserved residues, may generally not be altered without an adverse effect on biological activity. The non-critical amino acids need not be limited to those naturally occurring in proteins, such as L-α-amino acids, or their D-isomers, but may include non-natural amino acids as well, such as β-γ-δ-amino acids, as well as many derivatives of L-α-amino acids.

In some embodiments, the peptide may be modified using a series of peptides with single amino acid substitutions to determine the effect of electrostatic charge, hydrophobicity, etc. on HLA binding. For instance, a series of positively charged (e.g., Lys or Arg) or negatively charged (e.g., Glu) amino acid substitutions may be made along the length of the peptide revealing different patterns of sensitivity towards various HLA molecules and T cell receptors. In addition, multiple substitutions using small, relatively neutral moieties such as Ala, Gly, Pro, or similar residues may be employed. The substitutions may be homo-oligomers or hetero-oligomers. The number and types of residues which are substituted or added depend on the spacing necessary between essential contact points and certain functional attributes which are sought (e.g., hydrophobicity versus hydrophilicity). Increased binding affinity for an HLA molecule or T cell receptor may also be achieved by such substitutions, compared to the affinity of the parent peptide. In any event, such substitutions should employ amino acid residues or other molecular fragments chosen to avoid, for example, steric and charge interference which might disrupt binding. Amino acid substitutions are typically of single residues. Substitutions, deletions, insertions or any combination thereof may be combined to arrive at a final peptide.

In some embodiments, the peptide described herein can comprise amino acid mimetics or unnatural amino acid residues, e.g. D- or L-naphylalanine; D- or L-phenylglycine; D- or L-2-thieneylalanine; D- or L-1, -2, 3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoro-methyl)-phenylalanine; D-ρ-fluorophenylalanine; D- or L-ρ-biphenyl-phenylalanine; D- or L-ρ-methoxybiphenylphenylalanine; D- or L-2-indole(allyl)alanines; and, D- or L-alkylalanines, where the alkyl group can be a substituted or unsubstituted methyl, ethyl, propyl, hexyl, butyl, pentyl, isopropyl, iso-butyl, sec-isotyl, iso-pentyl, or a non-acidic amino acid residues. Aromatic rings of a non-natural amino acid include, e.g., thiazolyl, thiophenyl, pyrazolyl, benzimidazolyl, naphthyl, furanyl, pyrrolyl, and pyridyl aromatic rings. Modified peptides that have various amino acid mimetics or unnatural amino acid residues may have increased stability in vivo. Such peptides may also have improved shelf-life or manufacturing properties.

In some embodiments, a peptide described herein can be modified by terminal-$NH_2$ acylation, e.g., by alkanoyl($C_1$-$C_{20}$) or thioglycolyl acetylation, terminal-carboxyl amidation, e.g., ammonia, methylamine, etc. In some embodiments these modifications can provide sites for linking to a support or other molecule. In some embodiments, the peptide described herein can contain modifications such as but not limited to glycosylation, side chain oxidation, biotinylation, phosphorylation, addition of a surface active material, e.g. a lipid, or can be chemically modified, e.g., acetylation, etc. Moreover, bonds in the peptide can be other than peptide bonds, e.g., covalent bonds, ester or ether bonds, disulfide bonds, hydrogen bonds, ionic bonds, etc.

In some embodiments, a peptide described herein can comprise carriers such as those well known in the art, e.g., thyroglobulin, albumins such as human serum albumin, tetanus toxoid, polyamino acid residues such as poly L-lysine and poly L-glutamic acid, influenza virus proteins, hepatitis B virus core protein, and the like.

The peptides can be further modified to contain additional chemical moieties not normally part of a protein. Those derivatized moieties can improve the solubility, the biological half-life, absorption of the protein, or binding affinity. The moieties can also reduce or eliminate any desirable side effects of the peptides and the like. An overview for those moieties can be found in Remington's Pharmaceutical Sciences, 20th ed., Mack Publishing Co., Easton, PA (2000). For example, neoantigenic peptides having the desired activity may be modified as necessary to provide certain desired attributes, e.g. improved pharmacological characteristics, while increasing or at least retaining substantially all of the biological activity of the unmodified peptide to bind the desired HLA molecule and activate the appropriate T cell. For instance, the peptide may be subject to various changes, such as substitutions, either conservative or non-conservative, where such changes might provide for certain advantages in their use, such as improved HLA binding. Such conservative substitutions may encompass replacing an amino acid residue with another amino acid residue that is biologically and/or chemically similar, e.g., one hydrophobic residue for another, or one polar residue for another. The effect of single amino acid substitutions may also be probed using D-amino acids. Such modifications may be made using well known peptide synthesis procedures, as described in e.g., Merrifield, Science 232:341-347 (1986), Barany & Merrifield, The Peptides, Gross & Meienhofer, eds. (N.Y., Academic Press), pp. 1-284 (1979); and Stewart & Young, Solid Phase Peptide Synthesis, (Rockford, Ill., Pierce), 2d Ed. (1984).

In some embodiments, the peptide described herein may be conjugated to large, slowly metabolized macromolecules such as proteins; polysaccharides, such as sepharose, agarose, cellulose, cellulose beads; polymeric amino acids such as polyglutamic acid, polylysine; amino acid copolymers; inactivated virus particles; inactivated bacterial toxins such as toxoid from diphtheria, tetanus, cholera, leukotoxin molecules; inactivated bacteria; and dendritic cells.

Changes to the peptide that may include, but are not limited to, conjugation to a carrier protein, conjugation to a ligand, conjugation to an antibody, PEGylation, polysialylation HESylation, recombinant PEG mimetics, Fc fusion, albumin fusion, nanoparticle attachment, nanoparticulate encapsulation, cholesterol fusion, iron fusion, acylation, amidation, glycosylation, side chain oxidation, phosphorylation, biotinylation, the addition of a surface active material, the addition of amino acid mimetics, or the addition of unnatural amino acids.

Glycosylation can affect the physical properties of proteins and can also be important in protein stability, secretion, and subcellular localization. Proper glycosylation can be important for biological activity. In fact, some genes from eukaryotic organisms, when expressed in bacteria (e.g., *E. coli*) which lack cellular processes for glycosylating proteins, yield proteins that are recovered with little or no activity by virtue of their lack of glycosylation. Addition of glycosylation sites can be accomplished by altering the amino acid sequence. The alteration to the peptide or protein may be made, for example, by the addition of, or substitution by, one or more serine or threonine residues (for O-linked glycosylation sites) or asparagine residues (for N-linked glycosylation sites). The structures of N-linked and O-linked oligosaccharides and the sugar residues found in each type may be different. One type of sugar that is commonly found on both is N-acetylneuraminic acid (hereafter referred to as sialic acid). Sialic acid is usually the terminal residue of both N-linked and O-linked oligosaccharides and, by virtue of its negative charge, may confer acidic properties to the glycoprotein. Embodiments of the present disclosure comprise the generation and use of N-glycosylation variants. Removal of carbohydrates may be accomplished chemically or enzymatically, or by substitution of codons encoding amino acid residues that are glycosylated. Chemical deglycosylation techniques are known, and enzymatic cleavage of carbohydrate moieties on polypeptides can be achieved by the use of a variety of endo- and exo-glycosidases.

Additional suitable components and molecules for conjugation include, for example, molecules for targeting to the lymphatic system, thyroglobulin; albumins such as human serum albumin (HAS); tetanus toxoid; Diphtheria toxoid; polyamino acids such as poly(D-lysine:D-glutamic acid); VP6 polypeptides of rotaviruses; influenza virus hemagglutinin, influenza virus nucleoprotein; Keyhole Limpet Hemocyanin (KLH); and hepatitis B virus core protein and surface antigen; or any combination of the foregoing.

Another type of modification is to conjugate (e.g., link) one or more additional components or molecules at the N- and/or C-terminus of a polypeptide sequence, such as another protein (e.g., a protein having an amino acid sequence heterologous to the subject protein), or a carrier molecule. Thus, an exemplary polypeptide sequence can be provided as a conjugate with another component or molecule. In some embodiments, fusion of albumin to the peptide or protein of the present disclosure can, for example, be achieved by genetic manipulation, such that the DNA coding for HSA, or a fragment thereof, is joined to the DNA coding for the one or more polypeptide sequences. Thereafter, a suitable host can be transformed or transfected with the fused nucleotide sequences in the form of, for example, a suitable plasmid, so as to express a fusion polypeptide. The expression may be effected in vitro from, for example, prokaryotic or eukaryotic cells, or in vivo from, for example, a transgenic organism. In some embodiments of the present disclosure, the expression of the fusion protein is performed in mammalian cell lines, for example, CHO cell lines. Furthermore, albumin itself may be modified to extend its circulating half-life. Fusion of the modified albumin to one or more polypeptides can be attained by the genetic manipulation techniques described above or by chemical conjugation; the resulting fusion molecule has a half-life that exceeds that of fusions with non-modified albumin (see, e.g., WO2011/051489). Several albumin-binding strategies have been developed as alternatives for direct fusion, including albumin binding through a conjugated fatty acid chain (acylation). Because serum albumin is a transport protein for fatty acids, these natural ligands with albumin-binding activity have been used for half-life extension of small protein therapeutics.

Additional candidate components and molecules for conjugation include those suitable for isolation or purification. Non-limiting examples include binding molecules, such as biotin (biotin-avidin specific binding pair), an antibody, a receptor, a ligand, a lectin, or molecules that comprise a solid support, including, for example, plastic or polystyrene beads, plates or beads, magnetic beads, test strips, and membranes. Purification methods such as cation exchange chromatography may be used to separate conjugates by charge difference, which effectively separates conjugates into their various molecular weights. The content of the fractions obtained by cation exchange chromatography may be identified by molecular weight using conventional methods, for example, mass spectroscopy, SDS-PAGE, or other known methods for separating molecular entities by molecular weight.

In some embodiments, the amino- or carboxyl-terminus of the peptide or protein sequence of the present disclosure can be fused with an immunoglobulin Fc region (e.g., human Fc) to form a fusion conjugate (or fusion molecule). Fc fusion conjugates have been shown to increase the systemic half-life of biopharmaceuticals, and thus the biopharmaceutical product may require less frequent administration. Fc binds to the neonatal Fc receptor (FcRn) in endothelial cells that line the blood vessels, and, upon binding, the Fc fusion molecule is protected from degradation and re-released into the circulation, keeping the molecule in circulation longer. This Fc binding is believed to be the mechanism by which endogenous IgG retains its long plasma half-life. More recent Fc-fusion technology links a single copy of a biopharmaceutical to the Fc region of an antibody to optimize the pharmacokinetic and pharmacodynamics properties of the biopharmaceutical as compared to traditional Fc-fusion conjugates.

The present disclosure contemplates the use of other modifications, currently known or developed in the future, of the peptides to improve one or more properties. One such method for prolonging the circulation half-life, increasing the stability, reducing the clearance, or altering the immunogenicity or allergenicity of the peptide of the present disclosure involves modification of the peptide sequences by hesylation, which utilizes hydroxyethyl starch derivatives linked to other molecules in order to modify the molecule's characteristics. Various aspects of hesylation are described in, for example, U.S. Patent Appln. Nos. 2007/0134197 and 2006/0258607.

Peptide stability can be assayed in a number of ways. For instance, peptidases and various biological media, such as human plasma and serum, have been used to test stability. See, e.g., Verhoef, et al., Eur. J. Drug Metab. Pharmacokinetics 11:291 (1986). Half-life of the peptides described herein is conveniently determined using a 25% human serum (v/v) assay. The protocol is as follows: pooled human serum (Type AB, non-heat inactivated) is dilapidated by centrifugation before use. The serum is then diluted to 25% with RPMI-1640 or another suitable tissue culture medium. At predetermined time intervals, a small amount of reaction solution is removed and added to either 6% aqueous trichloroacetic acid (TCA) or ethanol. The cloudy reaction sample is cooled (4° C.) for 15 minutes and then spun to pellet the precipitated serum proteins. The presence of the peptides is then determined by reversed-phase HPLC using stability-specific chromatography conditions.

Issues associated with short plasma half-life or susceptibility to protease degradation may be overcome by various modifications, including conjugating or linking the peptide or protein sequence to any of a variety of non-proteinaceous polymers, e.g., polyethylene glycol (PEG), polypropylene glycol, or polyoxyalkylenes (see, for example, typically via a linking moiety covalently bound to both the protein and the nonproteinaceous polymer, e.g., a PEG). Such PEG conjugated biomolecules have been shown to possess clinically useful properties, including better physical and thermal stability, protection against susceptibility to enzymatic degradation, increased solubility, longer in vivo circulating half-life and decreased clearance, reduced immunogenicity and antigenicity, and reduced toxicity.

PEGs suitable for conjugation to a polypeptide or protein sequence are generally soluble in water at room temperature, and have the general formula R—(O—CH$_2$—CH$_2$)$_n$—O—R, where R is hydrogen or a protective group such as an alkyl or an alkanol group, and where n is an integer from 1 to 1000. When R is a protective group, it generally has from 1 to 8 carbons. The PEG conjugated to the polypeptide sequence can be linear or branched. Branched PEG derivatives, "star-PEGs" and multi-armed PEGs are contemplated by the present disclosure. The present disclosure also contemplates compositions of conjugates wherein the PEGs have different n values and thus the various different PEGs are present in specific ratios. For example, some compositions comprise a mixture of conjugates where n=1, 2, 3 and 4. In some compositions, the percentage of conjugates where n=1 is 18-25%, the percentage of conjugates where n=2 is 50-66%, the percentage of conjugates where n=3 is 12-16%, and the percentage of conjugates where n=4 is up to 5%. Such compositions can be produced by reaction conditions and purification methods know in the art. For example, cation exchange chromatography may be used to separate conjugates, and a fraction is then identified which contains the conjugate having, for example, the desired number of PEGs attached, purified free from unmodified protein sequences and from conjugates having other numbers of PEGs attached.

PEG may be bound to the peptide or protein of the present disclosure via a terminal reactive group (a "spacer"). The spacer is, for example, a terminal reactive group which mediates a bond between the free amino or carboxyl groups of one or more of the polypeptide sequences and PEG. The PEG having the spacer which may be bound to the free amino group includes N-hydroxysuccinylimide PEG which may be prepared by activating succinic acid ester of PEG with N-hydroxysuccinylimide. Another activated PEG which may be bound to a free amino group is 2,4-bis(O-methoxypolyethyleneglycol)-6-chloro-s-triazine which may be prepared by reacting PEG monomethyl ether with cyanuric chloride. The activated PEG which is bound to the free carboxyl group includes polyoxyethylenediamine.

Conjugation of one or more of the peptide or protein sequences of the present disclosure to PEG having a spacer may be carried out by various conventional methods. For example, the conjugation reaction can be carried out in solution at a pH of from 5 to 10, at temperature from 4° C. to room temperature, for 30 minutes to 20 hours, utilizing a molar ratio of reagent to peptide/protein of from 4:1 to 30:1. Reaction conditions may be selected to direct the reaction towards producing predominantly a desired degree of substitution. In general, low temperature, low pH (e.g., pH=5), and short reaction time tend to decrease the number of PEGs attached, whereas high temperature, neutral to high pH (e.g., pH>7), and longer reaction time tend to increase the number of PEGs attached. Various means known in the art may be used to terminate the reaction. In some embodiments the reaction is terminated by acidifying the reaction mixture and freezing at, e.g., −20° C.

The present disclosure also contemplates the use of PEG mimetics. Recombinant PEG mimetics have been developed that retain the attributes of PEG (e.g., enhanced serum half-life) while conferring several additional advantageous properties. By way of example, simple polypeptide chains (comprising, for example, Ala, Glu, Gly, Pro, Ser and Thr) capable of forming an extended conformation similar to PEG can be produced recombinantly already fused to the peptide or protein drug of interest (e.g., Amunix XTEN technology; Mountain View, CA). This obviates the need for an additional conjugation step during the manufacturing process. Moreover, established molecular biology techniques enable control of the side chain composition of the polypeptide chains, allowing optimization of immunogenicity and manufacturing properties.

B. Neoepitopes

A neoepitope comprises a neoantigenic determinant part of a neoantigenic peptide or neoantigenic polypeptide that is recognized by immune system. A neoepitope refers to an epitope that is not present in a reference, such as a non-diseased cell, e.g., a non-cancerous cell or a germline cell, but is found in a diseased cell, e.g., a cancer cell. This includes situations where a corresponding epitope is found in a normal non-diseased cell or a germline cell but, due to one or more mutations in a diseased cell, e.g., a cancer cell, the sequence of the epitope is changed so as to result in the neoepitope. The term "neoepitope" is used interchangeably with "tumor specific neoepitope" in the present specification to designate a series of residues, typically L-amino acids, connected one to the other, typically by peptide bonds between the α-amino and carboxyl groups of adjacent amino acids. The neoepitope can be a variety of lengths, either in their neutral (uncharged) forms or in forms which are salts, and either free of modifications such as glycosylation, side chain oxidation, or phosphorylation or containing these modifications, subject to the condition that the modification not destroy the biological activity of the polypeptides as herein described. The present disclosure provides isolated neoepitopes that comprise a tumor specific mutation from Tables 1 to 14.

In some embodiments, neoepitopes described herein for HLA Class I are 13 residues or less in length and usually consist of between about 8 and about 12 residues, particularly 9 or 10 residues. In some embodiments, neoepitopes described herein for HLA Class II are 25 residues or less in length and usually consist of between about 16 and about 25 residues.

In some embodiments, the composition described herein comprises a first peptide comprising a first neoepitope of a protein and a second peptide comprising a second neoepitope of the same protein, wherein the first peptide is different from the second peptide, and wherein the first neoepitope comprises a mutation and the second neoepitope comprises the same mutation. In some embodiments, the composition described herein comprises a first peptide comprising a first neoepitope of a first region of a protein and a second peptide comprising a second neoepitope of a second region of the same protein, wherein the first region comprises at least one amino acid of the second region, wherein the first peptide is different from the second peptide and wherein the first neoepitope comprises a first mutation and the second neoepitope comprises a second mutation. In some embodiments, the first mutation and the second mutation are the same. In some embodiments, the mutation is selected from the group consisting of a point mutation, a splice-site mutation, a frameshift mutation, a read-through mutation, a gene fusion mutation and any combination thereof.

In some embodiments, the first neoepitope binds to a class I HLA protein to form a class I HLA-peptide complex. In some embodiments, the second neoepitope binds to a class II HLA a protein to form a class II HLA-peptide complex. In some embodiments, the second neoepitope binds to a class I HLA protein to form a class I HLA-peptide complex. In some embodiments, the first neoepitope binds to a class II HLA protein to form a class II HLA-peptide complex. In some embodiments, the first neoepitope activates $CD8^+$ T cells. In some embodiments, the first neoepitope activates $CD4^+$ T cells. In some embodiments, the second neoepitope activates $CD4^+$ T cells. In some embodiments, the second neoepitope activates $CD8^+$ T cells. In some embodiments, a TCR of a $CD4^+$ T cell binds to a class II HLA-peptide complex. In some embodiments, a TCR of a $CD8^+$ T cell binds to a class II HLA-peptide complex. In some embodiments, a TCR of a $CD8^+$ T cell binds to a class I HLA-peptide complex. In some embodiments, a TCR of a $CD4^+$ T cell binds to a class I HLA-peptide complex.

In some embodiments, the second neoepitope is longer than the first neoepitope. In some embodiments, the first neoepitope has a length of at least 8 amino acids. In some embodiments, the first neoepitope has a length of from 8 to 12 amino acids. In some embodiments, the first neoepitope comprises a sequence of at least 8 contiguous amino acids, wherein at least 1 of the 8 contiguous amino acids are different at corresponding positions of a wild-type sequence. In some embodiments, the first neoepitope comprises a sequence of at least 8 contiguous amino acids, wherein at least 2 of the 8 contiguous amino acids are different at corresponding positions of a wild-type sequence. In some embodiments, the second neoepitope has a length of at least 16 amino acids. In some embodiments, the second neoepitope has a length of from 16 to 25 amino acids. In some embodiments, the second neoepitope comprises a sequence of at least 16 contiguous amino acids, wherein at least 1 of the 16 contiguous amino acids are different at corresponding positions of a wild-type sequence. In some embodiments, the second neoepitope comprises a sequence of at least 16 contiguous amino acids, wherein at least 2 of the 16 contiguous amino acids are different at corresponding positions of a wild-type sequence.

In some embodiments, the neoepitope comprises at least one anchor residue. In some embodiments, the first neoepitope, the second neoepitope or both comprises at least one anchor residue. In one embodiment, the at least one anchor residue of the first neoepitope is at a canonical anchor position or a non-canonical anchor position. In another embodiment, the at least one anchor residue of the second neoepitope is at a canonical anchor position or a non-canonical anchor position. In yet another embodiment, the at least one anchor residue of the first neoepitope is different from the at least one anchor residue of the second neoepitope.

In some embodiments, the at least one anchor residue is a wild-type residue. In some embodiments, the at least one anchor residue is a substitution. In some embodiments, at least one anchor residue does not comprise the mutation.

In some embodiments, the second neoepitope or both comprise at least one anchor residue flanking region. In some embodiments, the neoepitope comprises at least one anchor residue. In some embodiments, the at least one anchor residues comprises at least two anchor residues. In some embodiments, the at least two anchor residues are separated by a separation region comprising at least 1 amino acid. In some embodiments, the at least one anchor residue flanking region is not within the separation region. In some embodiments, the at least one anchor residue flanking region is (a) upstream of a N-terminal anchor residue of the at least two anchor residues; (b) downstream of a C-terminal anchor residue of the at least two anchor residues; or both (a) and (b).

In some embodiments, the neoepitopes bind an HLA protein (e.g., HLA class I or HLA class II). In some embodiments, the neoepitopes bind an HLA protein with greater affinity than the corresponding wild-type peptide. In some embodiments, the neoepitope has an $IC_{50}$ of less than 5,000 nM, less than 1,000 nM, less than 500 nM, less than 100 nM, less than 50 nM, or less.

In some embodiments, the neoepitope can have an HLA binding affinity of between about 1 pM and about 1 mM, about 100 pM and about 500 µM, about 500 pM and about 10 µM, about 1 nM and about 1 µM, or about 10 nM and about 1 µM. In some embodiments, the neoepitope can have an HLA binding affinity of at least 2, 3, 4, 5, 6, 7, 8, 9, 10, 15, 20, 25, 30, 35, 40, 45, 50, 55, 60, 65, 70, 75, 80, 85, 90, 95, 100, 150, 200, 250, 300, 350, 400, 450, 500, 550, 600, 700, 800, 900, or 1,000 nM, or more. In some embodiments, the neoepitope can have an HLA binding affinity of at most 2, 3, 4, 5, 6, 7, 8, 9, 10, 15, 20, 25, 30, 35, 40, 45, 50, 55, 60, 65, 70, 75, 80, 85, 90, 95, 100, 150, 200, 250, 300, 350, 400, 450, 500, 550, 600, 700, 800, 900, or 1,000 nM.

In some embodiments, the first and/or second neoepitope binds to an HLA protein with a greater affinity than a corresponding wild-type neoepitope. In some embodiments, the first and/or second neoepitope binds to an HLA protein with a $K_D$ or an $IC_{50}$ less than 1,000 nM, 900 nM, 800 nM, 700 nM, 600 nM, 500 nM, 250 nM, 150 nM, 100 nM, 50 nM, 25 nM or 10 nM. In some embodiments, the first and/or second neoepitope binds to an HLA class I protein with a $K_D$ or an $IC_{50}$ less than 1,000 nM, 900 nM, 800 nM, 700 nM, 600 nM, 500 nM, 250 nM, 150 nM, 100 nM, 50 nM, 25 nM or 10 nM. In some embodiments, the first and/or second neoepitope binds to an HLA class II protein with a $K_D$ or an IC$_{50}$ less than 2,000 nM, 1,500 nM, 1,000 nM, 900 nM, 800 nM, 700 nM, 600 nM, 500 nM, 250 nM, 150 nM, 100 nM, 50 nM, 25 nM or 10 nM.

In an aspect, the first and/or second neoepitope binds to a protein encoded by an HLA allele expressed by a subject. In another aspect, the mutation is not present in non-cancer cells of a subject. In yet another aspect, the first and/or second neoepitope is encoded by a gene or an expressed gene of a subject's cancer cells.

In some embodiments, the first neoepitope comprises a mutation as depicted in column 2 of Table 1 or 2 or column 1 of Tables 3 to 14. In some embodiments, the second neoepitope comprises a mutation as depicted in column 2 of Table 1 or 2 or column 1 of Tables 3 to 14. In some embodiments, the first neoepitope and the second neoepitope is derived from a TMPRSS2:ERG fusion protein. In some embodiments, the first neoepitope and the second neoepitope is derived from a TMPRSS2:ERG fusion protein comprising a sequence of S::E from the sequence

```
                                          (SEQ ID NO: 2135)
MALNS::EALSVVSEDQSLFECAYGTPHLAKTEMTASSSSDYGQTSKMS
PRVPQQDWALNSEALSV.
```

For example, the first neoepitope and the second neoepitope can comprise a sequence

```
                                          (SEQ ID NO: 2136)
ALNSEALSVV.
```

For example, the first neoepitope and the second neoepitope can comprise a sequence

```
                                          (SEQ ID NO: 2137)
MALNSEALSV.
```

In some embodiments, the first neoepitope and the second neoepitope is derived from a KRAS protein. In some embodiments, the first neoepitope and the second neoepitope is derived from a NRAS protein. In some embodiments, the first neoepitope and the second neoepitope is derived from a KRAS protein comprising a mutation of G12C, G12D, G12V, Q61H or Q61L substitution. In some embodiments, the first neoepitope and the second neoepitope is derived from a NRAS protein comprising a mutation of Q61K or Q61R substitution. In some embodiments, the neoepitope comprises a substitution mutation, e.g., the KRAS G12C, G12D, G12V, Q61H or Q61L mutation, or the NRAS Q61K or Q61R mutation. In some embodiments, the first neoepitope and the second neoepitope is derived from a KRAS or NRAS protein sequence of

```
                                          (SEQ ID NO: 2138)
MTEYKLVVVGACGVGKSALTIQLIQNHFVDEYDPTIEDSYRKQVVIDGE
TCLLDILDTAGQE.
```

For example, the first neoepitope and the second neoepitope can comprise a sequence

```
                                          (SEQ ID NO: 2139)
KLVVVGACGV.
```

For example, the first neoepitope and the second neoepitope can comprise a sequence

```
                                          (SEQ ID NO: 2140)
LVVVGACGV.
```

For example, the first neoepitope and the second neoepitope can comprise a sequence

```
                                          (SEQ ID NO: 2141)
VVGACGVGK.
```

For example, the first neoepitope and the second neoepitope can comprise a sequence

```
                                          (SEQ ID NO: 2142)
VVVGACGVGK.
```

In some embodiments, the first neoepitope and the second neoepitope is derived from a KRAS or NRAS protein sequence of

```
                                          (SEQ ID NO: 2143)
MTEYKLVVVGADGVGKSALTIQLIQNHFVDEYDPTIEDSYRKQVVIDGE
TCLLDILDTAGQEVVGADGVGK.
```

For example, the first neoepitope and the second neoepitope can comprise a sequence

```
                                          (SEQ ID NO: 2144)
VVVGADGVGK.
```

For example, the first neoepitope and the second neoepitope can comprise a sequence

```
                                          (SEQ ID NO: 2145)
KLVVVGADGV.
```

For example, the first neoepitope and the second neoepitope can comprise a sequence

```
                                          (SEQ ID NO: 2146)
LVVVGADGV.
```

In some embodiments, the first neoepitope and the second neoepitope is derived from a KRAS or NRAS protein sequence of

```
                                          (SEQ ID NO: 2147)
MTEYKLVVVGAVGVGKSALTIQLIQNHFVDEYDPTIEDSYRKQVVIDGE
TCLLDILDTAGQE.
```

For example, the first neoepitope and the second neoepitope can comprise a sequence

```
                                          (SEQ ID NO: 2148)
KLVVVGAVGV.
```

For example, the first neoepitope and the second neoepitope can comprise a sequence

```
                                          (SEQ ID NO: 2149)
LVVVGAVGV.
```

For example, the first neoepitope and the second neoepitope can comprise a sequence

```
                            (SEQ ID NO: 2150)
        VVGAVGVGK.
```

For example, the first neoepitope and the second neoepitope can comprise a sequence

```
                            (SEQ ID NO: 2151)
        VVVGAVGVGK.
```

In some embodiments, the first neoepitope and the second neoepitope is derived from a KRAS or NRAS protein sequence of

```
                            (SEQ ID NO: 2152)
AGGVGKSALTIQLIQNHFVDEYDPTIEDSYRKQVVIDGETCLLDILDTA
GHEEYSAMRDQYMRTGEGFLCVFAINNTKSFEDIHHYREQIKRVKDSED
VPM.
```

For example, the first neoepitope and the second neoepitope can comprise a sequence

```
                            (SEQ ID NO: 2153)
        ILDTAGHEEY.
```

In some embodiments, the first neoepitope and the second neoepitope is derived from a KRAS or NRAS protein sequence of

```
                            (SEQ ID NO: 2154)
AGGVGKSALTIQLIQNHFVDEYDPTIEDSYRKQVVIDGETCLLDILDTA
GLEEYSAMRDQYMRTGEGFLCVFAINNTKSFEDIHHYREQIKRVKDSED
VPM.
```

For example, the first neoepitope and the second neoepitope can comprise a sequence

```
                            (SEQ ID NO: 2155)
        ILDTAGLEEY.
```

For example, the first neoepitope and the second neoepitope can comprise a sequence

```
                            (SEQ ID NO: 2156)
        LLDILDTAGL.
```

In some embodiments, the first neoepitope and the second neoepitope is derived from a KRAS or NRAS protein sequence of

```
                            (SEQ ID NO: 2157)
AGGVGKSALTIQLIQNHFVDEYDPTIEDSYRKQVVIDGETCLLDILDTA
GKEEYSAMRDQYMRTGEGFLCVFAINNSKSFADINLYREQIKRVKDSDD
VPM.
```

For example, the first neoepitope and the second neoepitope can comprise a sequence

```
                            (SEQ ID NO: 2158)
        ILDTAGKEEY.
```

In some embodiments, the first neoepitope and the second neoepitope is derived from a KRAS or NRAS protein sequence of

```
                            (SEQ ID NO: 2159)
AGGVGKSALTIQLIQNHFVDEYDPTIEDSYRKQVVIDGETCLLDILDTA
GREEYSAMRDQYMRTGEGFLCVFAINNSKSFADINLYREQIKRVKDSDD
VPM.
```

For example, the first neoepitope and the second neoepitope can comprise a sequence

```
                            (SEQ ID NO: 2160)
        ILDTAGREEY.
```

In some embodiments, the neoepitope comprises a sequence selected from a group consisting of:

```
                            (SEQ ID NO: 2161)
        DTAGHEEY,
                            (SEQ ID NO: 2162)
        TAGHEEYSAM,
                            (SEQ ID NO: 2163)
        DILDTAGHE,
                            (SEQ ID NO: 2164)
        DILDTAGH,
                            (SEQ ID NO: 2165)
        ILDTAGHEE,
                            (SEQ ID NO: 2166)
        ILDTAGHE,
                            (SEQ ID NO: 2167)
        DILDTAGHEEY,
                            (SEQ ID NO: 2168)
        DTAGHEEYS,
                            (SEQ ID NO: 2169)
        LLDILDTAGH,
                            (SEQ ID NO: 2170)
        DILDTAGRE,
                            (SEQ ID NO: 2171)
        DILDTAGR,
                            (SEQ ID NO: 2172)
        ILDTAGREE,
                            (SEQ ID NO: 2173)
        ILDTAGRE,
                            (SEQ ID NO: 2174)
        CLLDILDTAGR,
                            (SEQ ID NO: 2175)
        TAGREEYSAM,
                            (SEQ ID NO: 2176)
        REEYSAMRD,
```

-continued

DTAGKEEYSAM, (SEQ ID NO: 2177)

CLLDILDTAGK, (SEQ ID NO: 2178)

DTAGKEEY, (SEQ ID NO: 2179)

LLDILDTAGK, (SEQ ID NO: 2180)

ILDTAGKE, (SEQ ID NO: 2181)

ILDTAGKEE, (SEQ ID NO: 2182)

DTAGLEEY, (SEQ ID NO: 2183)

ILDTAGLE, (SEQ ID NO: 2184)

DILDTAGL, (SEQ ID NO: 2185)

ILDTAGLEE, (SEQ ID NO: 2186)

GLEEYSAMRDQY, (SEQ ID NO: 2187)

LLDILDTAGLE, (SEQ ID NO: 2188)

LDILDTAGL, (SEQ ID NO: 2189)

DILDTAGLE, (SEQ ID NO: 2190)

DILDTAGLEEY, (SEQ ID NO: 2191)

AGVGKSAL, (SEQ ID NO: 2192)

GAAGVGKSAL, (SEQ ID NO: 2193)

AAGVGKSAL, (SEQ ID NO: 2194)

CGVGKSAL, (SEQ ID NO: 2195)

ACGVGKSAL, (SEQ ID NO: 2196)

DGVGKSAL, (SEQ ID NO: 2197)

ADGVGKSAL, (SEQ ID NO: 2198)

DGVGKSALTI, (SEQ ID NO: 2199)

GARGVGKSA, (SEQ ID NO: 2200)

KLVVVGARGV, (SEQ ID NO: 2201)

VVVGARGV, (SEQ ID NO: 2202)

SGVGKSAL, (SEQ ID NO: 2203)

-continued

VVVGASGVGK, (SEQ ID NO: 2204)

GASGVGKSAL, (SEQ ID NO: 2205)

VGVGKSAL, (SEQ ID NO: 2206)

VVVGAGCVGK, (SEQ ID NO: 2207)

KLVVVGAGC, (SEQ ID NO: 2208)

GDVGKSAL, (SEQ ID NO: 2209)

DVGKSALTI, (SEQ ID NO: 2210)

VVVGAGDVGK, (SEQ ID NO: 2211)

TAGKEEYSAM, (SEQ ID NO: 2212)

DTAGHEEYSAM, (SEQ ID NO: 2213)

TAGHEEYSA, (SEQ ID NO: 2214)

DTAGREEYSAM, (SEQ ID NO: 2215)

TAGKEEYSA, (SEQ ID NO: 2216)

AAGVGKSA, (SEQ ID NO: 2217)

AGCVGKSAL, (SEQ ID NO: 2218)

AGDVGKSAL, (SEQ ID NO: 2219)

AGKEEYSAMR, (SEQ ID NO: 2220)

AGVGKSALTI, (SEQ ID NO: 2221)

ARGVGKSAL, (SEQ ID NO: 2222)

ASGVGKSA, (SEQ ID NO: 2223)

ASGVGKSAL, (SEQ ID NO: 2224)

AVGVGKSA, (SEQ ID NO: 2225)

CVGKSALTI, (SEQ ID NO: 2226)

DILDTAGK, (SEQ ID NO: 2227)

DILDTAGREEY, (SEQ ID NO: 2228)

DTAGHEEYSAMR, (SEQ ID NO: 2229)

DTAGKEEYS, (SEQ ID NO: 2230)

-continued

| | |
|---|---|
| DTAGKEEYSAMR, | (SEQ ID NO: 2231) |
| DTAGLEEYS, | (SEQ ID NO: 2232) |
| DTAGLEEYSA, | (SEQ ID NO: 2233) |
| DTAGLEEYSAMR, | (SEQ ID NO: 2234) |
| DTAGREEYS, | (SEQ ID NO: 2235) |
| DTAGREEYSAMR, | (SEQ ID NO: 2236) |
| GAAGVGKSA, | (SEQ ID NO: 2237) |
| GACGVGKSA, | (SEQ ID NO: 2238) |
| GACGVGKSAL, | (SEQ ID NO: 2239) |
| GADGVGKS, | (SEQ ID NO: 2240) |
| GAGDVGKSA, | (SEQ ID NO: 2241) |
| GAGDVGKSAL, | (SEQ ID NO: 2242) |
| GASGVGKSA, | (SEQ ID NO: 2243) |
| GCVGKSAL, | (SEQ ID NO: 2244) |
| GCVGKSALTI, | (SEQ ID NO: 2245) |
| GHEEYSAM, | (SEQ ID NO: 2246) |
| GKEEYSAM, | (SEQ ID NO: 2247) |
| GLEEYSAMR, | (SEQ ID NO: 2248) |
| GREEYSAM, | (SEQ ID NO: 2249) |
| GREEYSAMR, | (SEQ ID NO: 2250) |
| HEEYSAMRD, | (SEQ ID NO: 2251) |
| KEEYSAMRD, | (SEQ ID NO: 2252) |
| KLVVVGASG, | (SEQ ID NO: 2253) |
| LDILDTAGR, | (SEQ ID NO: 2254) |
| LEEYSAMRD, | (SEQ ID NO: 2255) |
| LVVVGARGV, | (SEQ ID NO: 2256) |
| LVVVGASGV, | (SEQ ID NO: 2257) |
| REEYSAMRDQY, | (SEQ ID NO: 2258) |
| RGVGKSAL, | (SEQ ID NO: 2259) |
| TAGLEEYSA, | (SEQ ID NO: 2260) |
| TEYKLVVVGAA, | (SEQ ID NO: 2261) |
| VGAAGVGKSA, | (SEQ ID NO: 2262) |
| VGADGVGK, | (SEQ ID NO: 2263) |
| VGASGVGKSA, | (SEQ ID NO: 2264) |
| VGVGKSALTI, | (SEQ ID NO: 2265) |
| VVVGAAGV, | (SEQ ID NO: 2266) |
| VVVGAVGV, | (SEQ ID NO: 2267) |
| YKLVVVGAC, | (SEQ ID NO: 2268) |
| YKLVVVGAD, | (SEQ ID NO: 2269) |
| YKLVVVGAR, and | (SEQ ID NO: 2270) |
| DILDTAGKE. | (SEQ ID NO: 2271) |

The substitution may be positioned anywhere along the length of the neoepitope. For example, it can be located in the N terminal third of the peptide, the central third of the peptide or the C terminal third of the peptide. In another embodiment, the substituted residue is located 2-5 residues away from the N terminal end or 2-5 residues away from the C terminal end. The peptides can be similarly derived from tumor specific insertion mutations where the peptide comprises one or more, or all of the inserted residues.

In some embodiments, the peptide as described herein can be readily synthesized chemically utilizing reagents that are free of contaminating bacterial or animal substances (Merrifield R B: Solid phase peptide synthesis. I. The synthesis of a tetrapeptide. J. Am. Chem. Soc. 85:2149-54, 1963). In some embodiments, peptides are prepared by (1) parallel solid-phase synthesis on multi-channel instruments using uniform synthesis and cleavage conditions; (2) purification over a RP-HPLC column with column stripping; and re-washing, but not replacement, between peptides; followed by (3) analysis with a limited set of the most informative assays. The Good Manufacturing Practices (GMP) footprint can be defined around the set of peptides for an individual patient, thus requiring suite changeover procedures only between syntheses of peptides for different patients.

C. Polynucleotides

Alternatively, a nucleic acid (e.g., a polynucleotide) encoding the peptide of the present disclosure may be used to produce the neoantigenic peptide in vitro. The polynucleotide may be, e.g., DNA, cDNA, PNA, CNA, RNA, either single- and/or double-stranded, or native or stabilized forms of polynucleotides, such as e.g. polynucleotides with a phosphorothiate backbone, or combinations thereof and it may or may not contain introns so long as it codes for the peptide. In some embodiments in vitro translation is used to produce the peptide.

Provided herein are neoantigenic polynucleotides encoding each of the neoantigenic peptides described in the present disclosure. The term "polynucleotide", "nucleotides" or "nucleic acid" is used interchangeably with "mutant polynucleotide", "mutant nucleotide", "mutant nucleic acid", "neoantigenic polynucleotide", "neoantigenic nucleotide" or "neoantigenic mutant nucleic acid" in the present disclosure. Various nucleic acid sequences can encode the same peptide due to the redundancy of the genetic code. Each of these nucleic acids falls within the scope of the present disclosure. Nucleic acids encoding peptides can be DNA or RNA, for example, mRNA, or a combination of DNA and RNA. In some embodiments, a nucleic acid encoding a peptide is a self-amplifying mRNA (Brito et al., Adv. Genet. 2015; 89:179-233). Any suitable polynucleotide that encodes a peptide described herein falls within the scope of the present disclosure.

The term "RNA" includes and in some embodiments relates to "mRNA." The term "mRNA" means "messenger-RNA" and relates to a "transcript" which is generated by using a DNA template and encodes a peptide or polypeptide. Typically, an mRNA comprises a 5'-UTR, a protein coding region, and a 3'-UTR. mRNA only possesses limited half-life in cells and in vitro. In some embodiments, the mRNA is self-amplifying mRNA. In the context of the present disclosure, mRNA may be generated by in vitro transcription from a DNA template. The in vitro transcription methodology is known to the skilled person. For example, there is a variety of in vitro transcription kits commercially available.

The stability and translation efficiency of RNA may be modified as required. For example, RNA may be stabilized and its translation increased by one or more modifications having a stabilizing effects and/or increasing translation efficiency of RNA. Such modifications are described, for example, in PCT/EP2006/009448, incorporated herein by reference. In order to increase expression of the RNA used according to the present disclosure, it may be modified within the coding region, i.e., the sequence encoding the expressed peptide or protein, without altering the sequence of the expressed peptide or protein, so as to increase the GC-content to increase mRNA stability and to perform a codon optimization and, thus, enhance translation in cells.

The term "modification" in the context of the RNA used in the present disclosure includes any modification of an RNA which is not naturally present in said RNA. In some embodiments, the RNA does not have uncapped 5'-triphosphates. Removal of such uncapped 5'-triphosphates can be achieved by treating RNA with a phosphatase. In other embodiments, the RNA may have modified ribonucleotides in order to increase its stability and/or decrease cytotoxicity. In some embodiments, 5-methylcytidine can be substituted partially or completely in the RNA, for example, for cytidine. Alternatively, pseudouridine is substituted partially or completely, for example, for uridine.

In some embodiments, the term "modification" relates to providing an RNA with a 5'-cap or 5'-cap analog. The term "5'-cap" refers to a cap structure found on the 5'-end of an mRNA molecule and generally consists of a guanosine nucleotide connected to the mRNA via an unusual 5' to 5' triphosphate linkage. In some embodiments, this guanosine is methylated at the 7-position. The term "conventional 5'-cap" refers to a naturally occurring RNA 5'-cap, to the 7-methylguanosine cap (m G). In the context of the present disclosure, the term "5'-cap" includes a 5'-cap analog that resembles the RNA cap structure and is modified to possess the ability to stabilize RNA and/or enhance translation of RNA if attached thereto, in vivo and/or in a cell.

In certain embodiments, an mRNA encoding a neoantigenic peptide of the present disclosure is administered to a subject in need thereof. In some embodiments, the present disclosure provides RNA, oligoribonucleotide, and polyribonucleotide molecules comprising a modified nucleoside, gene therapy vectors comprising same, gene therapy methods and gene transcription silencing methods comprising same. In some embodiments, the mRNA to be administered comprises at least one modified nucleoside.

The polynucleotides encoding peptides described herein can be synthesized by chemical techniques, for example, the phosphotriester method of Matteucci, et al., J. Am. Chem. Soc. 103:3185 (1981). Polynucleotides encoding peptides comprising or consisting of an analog can be made simply by substituting the appropriate and desired nucleic acid base(s) for those that encode the native epitope.

Polynucleotides described herein can comprise one or more synthetic or naturally-occurring introns in the transcribed region. The inclusion of mRNA stabilization sequences and sequences for replication in mammalian cells can also be considered for increasing polynucleotide expression. In addition, a polynucleotide described herein can comprise immunostimulatory sequences (ISSs or CpGs). These sequences can be included in the vector, outside the polynucleotide coding sequence to enhance immunogenicity.

In some embodiments, the polynucleotides may comprise the coding sequence for the peptide or protein fused in the same reading frame to a polynucleotide which aids, for example, in expression and/or secretion of the peptide or protein from a host cell (e.g., a leader sequence which functions as a secretory sequence for controlling transport of a polypeptide from the cell). The polypeptide having a leader sequence is a pre-protein and can have the leader sequence cleaved by the host cell to form the mature form of the polypeptide.

In some embodiments, the polynucleotides can comprise the coding sequence for the peptide or protein fused in the same reading frame to a marker sequence that allows, for example, for purification of the encoded peptide, which may then be incorporated into a personalized disease vaccine or immunogenic composition. For example, the marker sequence can be a hexa-histidine tag (SEQ ID NO: 2272) supplied by a pQE-9 vector to provide for purification of the mature polypeptide fused to the marker in the case of a bacterial host, or the marker sequence can be a hemagglutinin (HA) tag derived from the influenza hemagglutinin protein when a mammalian host (e.g., COS-7 cells) is used. Additional tags include, but are not limited to, Calmodulin tags, FLAG tags, Myc tags, S tags, SBP tags, Softag 1, Softag 3, V5 tag, Xpress tag, Isopeptag, SpyTag, Biotin Carboxyl Carrier Protein (BCCP) tags, GST tags, fluorescent protein tags (e.g., green fluorescent protein tags), maltose binding protein tags, Nus tags, Strep-tag, thioredoxin tag, TC tag, Ty tag, and the like.

In some embodiments, the polynucleotides may comprise the coding sequence for one or more the presently described peptides or proteins fused in the same reading frame to create a single concatamerized neoantigenic peptide construct capable of producing multiple neoantigenic peptides.

In some embodiments, a DNA sequence is constructed using recombinant technology by isolating or synthesizing a DNA sequence encoding a wild-type protein of interest. Optionally, the sequence can be mutagenized by site-specific mutagenesis to provide functional analogs thereof. See, e.g. Zoeller et al., Proc. Nat'l. Acad. Sci. USA 81:5662-5066 (1984) and U.S. Pat. No. 4,588,585. In another embodiment, a DNA sequence encoding the peptide or protein of interest would be constructed by chemical synthesis using an oligonucleotide synthesizer. Such oligonucleotides can be designed based on the amino acid sequence of the desired peptide and selecting those codons that are favored in the host cell in which the recombinant polypeptide of interest is produced. Standard methods can be applied to synthesize an isolated polynucleotide sequence encoding an isolated polypeptide of interest. For example, a complete amino acid sequence can be used to construct a back-translated gene. Further, a DNA oligomer containing a nucleotide sequence coding for the particular isolated polypeptide can be synthesized. For example, several small oligonucleotides coding for portions of the desired polypeptide can be synthesized and then ligated. The individual oligonucleotides typically contain 5' or 3' overhangs for complementary assembly Once assembled (e.g., by synthesis, site-directed mutagenesis, or another method), the polynucleotide sequences encoding a particular isolated polypeptide of interest is inserted into an expression vector and optionally operatively linked to an expression control sequence appropriate for expression of the protein in a desired host. Proper assembly can be confirmed by nucleotide sequencing, restriction mapping, and expression of a biologically active polypeptide in a suitable host. As well known in the art, in order to obtain high expression levels of a transfected gene in a host, the gene can be operatively linked to transcriptional and translational expression control sequences that are functional in the chosen expression host.

Thus, the present disclosure is also directed to vectors, and expression vectors useful for the production and administration of the neoantigenic peptides and neoepitopes described herein, and to host cells comprising such vectors.

IV. Vectors

In some embodiments, an expression vector capable of expressing the peptide or protein as described herein can also be prepared. Expression vectors for different cell types are well known in the art and can be selected without undue experimentation. Generally, the DNA is inserted into an expression vector, such as a plasmid, in proper orientation and correct reading frame for expression. If necessary, the DNA may be linked to the appropriate transcriptional and translational regulatory control nucleotide sequences recognized by the desired host (e.g., bacteria), although such controls are generally available in the expression vector. The vector is then introduced into the host bacteria for cloning using standard techniques (see, e.g., Sambrook et al. (1989) Molecular Cloning, A Laboratory Manual, Cold Spring Harbor Laboratory, Cold Spring Harbor, N.Y.).

A large number of vectors and host systems suitable for producing and administering a neoantigenic peptide described herein are known to those of skill in the art, and are commercially available. The following vectors are provided by way of example. Bacterial: pQE70, pQE60, pQE-9 (Qiagen), pBS, pD10, phagescript, psiX174, pBluescript SK, pbsks, pNH8A, pNH16a, pNH18A, pNH46A (Stratagene); ptrc99a, pKK223-3, pKK233-3, pDR540, pRIT5 (Pharmacia); pCR (Invitrogen). Eukaryotic: pWLNEO, pSV2CAT, pOG44, pXT1, pSG (Stratagene) pSVK3, pBPV, pMSG, pSVL (Pharmacia); p75.6 (Valentis); pCEP (Invitrogen); pCEI (Epimmune). However, any other plasmid or vector can be used as long as it is replicable and viable in the host.

For expression of the neoantigenic peptides described herein, the coding sequence will be provided operably linked start and stop codons, promoter and terminator regions, and in some embodiments, and a replication system to provide an expression vector for expression in the desired cellular host. For example, promoter sequences compatible with bacterial hosts are provided in plasmids containing convenient restriction sites for insertion of the desired coding sequence. The resulting expression vectors are transformed into suitable bacterial hosts.

Mammalian expression vectors will comprise an origin of replication, a suitable promoter and enhancer, and also any necessary ribosome binding sites, polyadenylation site, splice donor and acceptor sites, transcriptional termination sequences, and 5' flanking nontranscribed sequences. Such promoters can also be derived from viral sources, such as, e.g., human cytomegalovirus (CMV-IE promoter) or herpes simplex virus type-1 (HSV TK promoter). Nucleic acid sequences derived from the SV40 splice, and polyadenylation sites can be used to provide the required nontranscribed genetic elements.

Recombinant expression vectors may be used to amplify and express DNA encoding the peptide or protein as described herein. Recombinant expression vectors are replicable DNA constructs which have synthetic or cDNA-derived DNA fragments encoding a peptide or a bioequivalent analog operatively linked to suitable transcriptional or translational regulatory elements derived from mammalian, microbial, viral or insect genes. A transcriptional unit generally comprises an assembly of (1) a genetic element or elements having a regulatory role in gene expression, for example, transcriptional promoters or enhancers, (2) a structural or coding sequence which is transcribed into mRNA and translated into protein, and (3) appropriate transcription and translation initiation and termination sequences, as described in detail herein. Such regulatory elements can include an operator sequence to control transcription. The ability to replicate in a host, usually conferred by an origin of replication, and a selection gene to facilitate recognition of transformants can additionally be incorporated. DNA regions are operatively linked when they are functionally related to each other. For example, DNA for a signal peptide (secretory leader) is operatively linked to DNA for a polypeptide if it is expressed as a precursor which participates in the secretion of the polypeptide; a promoter is operatively linked to a coding sequence if it controls the transcription of the sequence; or a ribosome binding site is operatively linked to a coding sequence if it is positioned so as to permit translation. Generally, operatively linked means contiguous, and in the case of secretory leaders, means contiguous and in reading frame. Structural elements intended for use in yeast expression systems include a leader sequence enabling extracellular secretion of translated protein by a host cell. Alternatively, where recombinant protein is expressed without a leader or transport sequence, it can include an N-terminal methionine residue. This residue can optionally be subsequently cleaved from the expressed recombinant protein to provide a final product.

Generally, recombinant expression vectors will include origins of replication and selectable markers permitting transformation of the host cell, e.g., the ampicillin resistance gene of E. coli and S. cerevisiae TRP1 gene, and a promoter derived from a highly-expressed gene to direct transcription of a downstream structural sequence. Such promoters can be derived from operons encoding glycolytic enzymes such as 3-phosphoglycerate kinase (PGK), acid phosphatase, or heat shock proteins, among others. The heterologous structural sequence is assembled in appropriate phase with translation initiation and termination sequences, and in some embodiments, a leader sequence capable of directing secretion of translated protein into the periplasmic space or extracellular medium. Optionally, the heterologous sequence can encode a fusion protein including an N-terminal identification peptide imparting desired characteristics, e.g., stabilization or simplified purification of expressed recombinant product.

Polynucleotides encoding neoantigenic peptides described herein can also comprise a ubiquitination signal sequence, and/or a targeting sequence such as an endoplasmic reticulum (ER) signal sequence to facilitate movement of the resulting peptide into the endoplasmic reticulum.

In some embodiments, the neoantigenic peptide described herein can also be administered and/or expressed by viral or bacterial vectors. Examples of expression vectors include attenuated viral hosts, such as vaccinia or fowlpox. As an example of this approach, vaccinia virus is used as a vector to express nucleotide sequences that encode the neoantigenic peptides described herein. Vaccinia vectors and methods useful in immunization protocols are described in, e.g., U.S. Pat. No. 4,722,848. Another vector is BCG (Bacille Calmette Guerin). BCG vectors are described by Stover et al., Nature 351:456-460 (1991).

A wide variety of other vectors useful for therapeutic administration or immunization of the neoantigenic polypeptides described herein, e.g. adeno and adeno-associated virus vectors, retroviral vectors, *Salmonella typhimurium* vectors, detoxified anthrax toxin vectors, Sendai virus vectors, poxvirus vectors, canarypox vectors, and fowlpox vectors, and the like, will be apparent to those skilled in the art from the description herein. In some embodiments, the vector is Modified Vaccinia Ankara (VA) (e.g. Bavarian Noridic (MVA-BN)).

Among vectors that may be used in the practice of the present disclosure, integration in the host genome of a cell is possible with retrovirus gene transfer methods, often resulting in long term expression of the inserted transgene. In some embodiments, the retrovirus is a lentivirus. Additionally, high transduction efficiencies have been observed in many different cell types and target tissues. The tropism of a retrovirus can be altered by incorporating foreign envelope proteins, expanding the potential target population of target cells. A retrovirus can also be engineered to allow for conditional expression of the inserted transgene, such that only certain cell types are infected by the lentivirus. Cell type specific promoters can be used to target expression in specific cell types. Lentiviral vectors are retroviral vectors (and hence both lentiviral and retroviral vectors may be used in the practice of the present disclosure). Moreover, lentiviral vectors are able to transduce or infect non-dividing cells and typically produce high viral titers. Selection of a retroviral gene transfer system may therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the desired nucleic acid into the target cell to provide permanent expression. Widely used retroviral vectors that may be used in the practice of the present disclosure include those based upon murine leukemia virus (MuLV), gibbon ape leukemia virus (GaLV), Simian Immunodeficiency virus (SIV), human immunodeficiency virus (HIV), and combinations thereof (see, e.g., Buchscher et al., (1992) J. Virol. 66:2731-2739; Johann et al., (1992) J. Virol. 66:1635-1640; Sommnerfelt et al., (1990) Virol. 176:58-59; Wilson et al., (1998) J. Virol. 63:2374-2378; Miller et al., (1991) J. Virol. 65:2220-2224; PCT/US94/05700).

Also useful in the practice of the present disclosure is a minimal non-primate lentiviral vector, such as a lentiviral vector based on the equine infectious anemia virus (EIAV). The vectors may have cytomegalovirus (CMV) promoter driving expression of the target gene. Accordingly, the present disclosure contemplates amongst vector(s) useful in the practice of the present disclosure: viral vectors, including retroviral vectors and lentiviral vectors.

Also useful in the practice of the present disclosure is an adenovirus vector. One advantage is the ability of recombinant adenoviruses to efficiently transfer and express recombinant genes in a variety of mammalian cells and tissues in vitro and in vivo, resulting in the high expression of the transferred nucleic acids. Further, the ability to productively infect quiescent cells, expands the utility of recombinant adenoviral vectors. In addition, high expression levels ensure that the products of the nucleic acids will be expressed to sufficient levels to generate an immune response (see e.g., U.S. Pat. No. 7,029,848, hereby incorporated by reference).

As to adenovirus vectors useful in the practice of the present disclosure, mention is made of U.S. Pat. No. 6,955,808. The adenovirus vector used can be selected from the group consisting of the Ad5, Ad35, Ad11, C6, and C7 vectors. The sequence of the Adenovirus 5 ("Ad5") genome has been published. (Chroboczek, J., Bieber, F., and Jacrot, B. (1992) The Sequence of the Genome of Adenovirus Type 5 and Its Comparison with the Genome of Adenovirus Type 2, Virology 186, 280-285; the contents if which is hereby incorporated by reference). Ad35 vectors are described in U.S. Pat. Nos. 6,974,695, 6,913,922, and 6,869,794. Ad11 vectors are described in U.S. Pat. No. 6,913,922. C6 adenovirus vectors are described in U.S. Pat. Nos. 6,780,407; 6,537,594; 6,309,647; 6,265,189; 6,156,567; 6,090,393; 5,942,235 and 5,833,975. C7 vectors are described in U.S. Pat. No. 6,277,558. Adenovirus vectors that are E1-defective or deleted, E3-defective or deleted, and/or E4-defective or deleted may also be used. Certain adenoviruses having mutations in the E1 region have improved safety margin because E1-defective adenovirus mutants are replication-defective in non-permissive cells, or, at the very least, are highly attenuated. Adenoviruses having mutations in the E3 region may have enhanced the immunogenicity by disrupting the mechanism whereby adenovirus down-regulates MHC class I molecules. Adenoviruses having E4 mutations may have reduced immunogenicity of the adenovirus vector because of suppression of late gene expression. Such vectors may be particularly useful when repeated re-vaccination utilizing the same vector is desired. Adenovirus vectors that are deleted or mutated in E1, E3, E4; E1 and E3; and E1 and E4 can be used in accordance with the present disclosure.

Furthermore, "gutless" adenovirus vectors, in which all viral genes are deleted, can also be used in accordance with the present disclosure. Such vectors require a helper virus for their replication and require a special human 293 cell line expressing both E1a and Cre, a condition that does not exist in natural environment. Such "gutless" vectors are non-immunogenic and thus the vectors may be inoculated multiple times for re-vaccination. The "gutless" adenovirus vectors can be used for insertion of heterologous inserts/ genes such as the transgenes of the present disclosure, and can even be used for co-delivery of a large number of heterologous inserts/genes.

In some embodiments, the delivery is via an adenovirus, which may be at a single booster dose. In some embodiments, the adenovirus is delivered via multiple doses. In terms of in vivo delivery, AAV is advantageous over other viral vectors due to low toxicity and low probability of causing insertional mutagenesis because it doesn't integrate into the host genome. AAV has a packaging limit of 4.5 or 4.75 Kb. Constructs larger than 4.5 or 4.75 Kb result in significantly reduced virus production. There are many promoters that can be used to drive nucleic acid molecule expression. AAV ITR can serve as a promoter and is advantageous for eliminating the need for an additional promoter element.

For ubiquitous expression, the following promoters can be used: CMV, CAG, CBh, PGK, SV40, Ferritin heavy or light chains, etc. For brain expression, the following promoters can be used: Synapsin I for all neurons, CaMK II alpha for excitatory neurons, GAD67 or GAD65 or VGAT for GABAergic neurons, etc. Promoters used to drive RNA synthesis can include: Pol III promoters such as U6 or H1. The use of a Pol II promoter and intronic cassettes can be used to express guide RNA (gRNA). With regard to AAV vectors useful in the practice of the present disclosure, mention is made of U.S. Pat. Nos. 5,658,785, 7,115,391, 7,172,893, 6,953,690, 6,936,466, 6,924,128, 6,893,865, 6,793,926, 6,537,540, 6,475,769 and 6,258,595, and documents cited therein. As to AAV, the AAV can be AAV1, AAV2, AAV5 or any combination thereof. One can select the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. In some embodiments the delivery is via an AAV. The dosage may be adjusted to balance the therapeutic benefit against any side effects.

In some embodiments, a Poxvirus is used in the presently described composition. These include orthopoxvirus, avipox, vaccinia, MVA, NYVAC, canarypox, ALVAC, fowlpox, TROVAC, etc. (see e.g., Verardi et. al.., Hum. Vaccin. Immunother. 2012 July; 8(7):961-70; and Moss, Vaccine. 2013; 31(39): 4220-4222). Poxvirus expression vectors were described in 1982 and quickly became widely used for vaccine development as well as research in numerous fields. Advantages of the vectors include simple construction, ability to accommodate large amounts of foreign DNA and high expression levels. Information concerning poxviruses that may be used in the practice of the present disclosure, such as Chordopoxvirinae subfamily poxviruses (poxviruses of vertebrates), for instance, orthopoxviruses and avipoxviruses, e.g., vaccinia virus (e.g., Wyeth Strain, WR Strain (e.g., ATCC® VR-1354), Copenhagen Strain, NYVAC, NYVAC.1, NYVAC.2, MVA, MVA-BN), canarypox virus (e.g., Wheatley C93 Strain, ALVAC), fowlpox virus (e.g., FP9 Strain, Webster Strain, TROVAC), dovepox, pigeonpox, quailpox, and raccoon pox, inter alia, synthetic or non-naturally occurring recombinants thereof, uses thereof, and methods for making and using such recombinants may be found in scientific and patent literature.

In some embodiments, the vaccinia virus is used in the disease vaccine or immunogenic composition to express a antigen. (Rolph et al., Recombinant viruses as vaccines and immunological tools. Curr. Opin. Immunol. 9:517-524, 1997). The recombinant vaccinia virus is able to replicate within the cytoplasm of the infected host cell and the polypeptide of interest can therefore induce an immune response. Moreover, Poxviruses have been widely used as vaccine or immunogenic composition vectors because of their ability to target encoded antigens for processing by the major histocompatibility complex class I pathway by directly infecting immune cells, in particular antigen-presenting cells, but also due to their ability to self-adjuvant.

In some embodiments, ALVAC is used as a vector in a disease vaccine or immunogenic composition. ALVAC is a canarypox virus that can be modified to express foreign transgenes and has been used as a method for vaccination against both prokaryotic and eukaryotic antigens (Horig H, Lee D S, Conkright W, et al. Phase I clinical trial of a recombinant canarypoxvirus (ALVAC) vaccine expressing human carcinoembryonic antigen and the B7.1 co-stimulatory molecule. Cancer Immunol. Immunother. 2000; 49:504-14; von Mehren M, Arlen P, Tsang K Y, et al. Pilot study of a dual gene recombinant avipox vaccine containing both carcinoembryonic antigen (CEA) and B7.1 transgenes in patients with recurrent CEA-expressing adenocarcinomas. Clin. Cancer. Res. 2000; 6:2219-28; Musey L, Ding Y, Elizaga M, et al. HIV-1 vaccination administered intramuscularly can induce both systemic and mucosal T cell immunity in HIV-1-uninfected individuals. J. Immunol. 2003; 171:1094-101; Paoletti E. Applications of pox virus vectors to vaccination: an update. Proc. Natl. Acad. Sci. USA 1996; 93:11349-53; U.S. Pat. No. 7,255,862). In a phase I clinical trial, an ALVAC virus expressing the tumor antigen CEA showed an excellent safety profile and resulted in increased CEA-specific T cell responses in selected patients; objective clinical responses, however, were not observed (Marshall J L, Hawkins M J, Tsang K Y, et al. Phase I study in cancer patients of a replication-defective avipox recombinant vaccine that expresses human carcinoembryonic antigen. J. Clin. Oncol. 1999; 17:332-7).

In some embodiments, a Modified Vaccinia Ankara (MVA) virus may be used as a viral vector for an antigen vaccine or immunogenic composition. MVA is a member of the Orthopoxvirus family and has been generated by about 570 serial passages on chicken embryo fibroblasts of the Ankara strain of Vaccinia virus (CVA) (see, e.g., Mayr, A., et al., Infection 3, 6-14, 1975). As a consequence of these passages, the resulting MVA virus contains 31 kilobases less genomic information compared to CVA, and is highly host cell restricted (Meyer, H. et al., J. Gen. Virol. 72, 1031-1038, 1991). MVA is characterized by its extreme attenuation, namely, by a diminished virulence or infectious ability, but still holds an excellent immunogenicity. When tested in a variety of animal models, MVA was proven to be avirulent, even in immuno-suppressed individuals. Moreover, MVA-BN®-HER2 is a candidate immunotherapy designed for the treatment of HER-2-positive breast cancer and is currently in clinical trials. (Mandl et al., Cancer Immunol. Immunother. January 2012; 61(1): 19-29). Methods to make and use recombinant MVA has been described (e.g., see U.S. Pat. Nos. 8,309,098 and 5,185,146 hereby incorporated in its entirety).

Suitable host cells for expression of a polypeptide include prokaryotes, yeast, insect or higher eukaryotic cells under the control of appropriate promoters. Prokaryotes include gram negative or gram positive organisms, for example E. coli or bacilli. Higher eukaryotic cells include established cell lines of mammalian origin. Cell-free translation systems could also be employed. Appropriate cloning and expression vectors for use with bacterial, fungal, yeast, and mammalian cellular hosts are well known in the art (see Pouwels et al., Cloning Vectors: A Laboratory Manual, Elsevier, N.Y., 1985).

Various mammalian or insect cell culture systems are also advantageously employed to express recombinant protein. Expression of recombinant proteins in mammalian cells can be performed because such proteins are generally correctly folded, appropriately modified and completely functional. Examples of suitable mammalian host cell lines include the COS-7 lines of monkey kidney cells, described by Gluzman (Cell 23:175, 1981), and other cell lines capable of expressing an appropriate vector including, for example, L cells, C127, 3T3, Chinese hamster ovary (CHO), 293, HeLa and BHK cell lines. Mammalian expression vectors can comprise nontranscribed elements such as an origin of replication, a suitable promoter and enhancer linked to the gene to be expressed, and other 5' or 3' flanking nontranscribed sequences, and 5' or 3' nontranslated sequences, such as necessary ribosome binding sites, a polyadenylation site, splice donor and acceptor sites, and transcriptional termination sequences. Baculovirus systems for production of heterologous proteins in insect cells are reviewed by Luckow and Summers, Bio/Technology 6:47 (1988).

Host cells are genetically engineered (transduced or transformed or transfected) with the vectors which can be, for example, a cloning vector or an expression vector. The vector can be, for example, in the form of a plasmid, a viral particle, a phage, etc. The engineered host cells can be cultured in conventional nutrient media modified as appropriate for activating promoters, selecting transformants or amplifying the polynucleotides. The culture conditions, such as temperature, pH and the like, are those previously used with the host cell selected for expression, and will be apparent to the ordinarily skilled artisan.

As representative examples of appropriate hosts, there can be mentioned: bacterial cells, such as *E. coli, Bacillus subtilis, Salmonella typhimurium* and various species within the genera *Pseudomonas, Streptomyces*, and *Staphylococcus*; fungal cells, such as yeast; insect cells such as *Drosophila* and Sf9; animal cells such as COS-7 lines of monkey kidney fibroblasts, described by Gluzman, Cell 23:175 (1981), and other cell lines capable of expressing a compatible vector, for example, the C127, 3T3, CHO, HeLa and BHK cell lines or Bowes melanoma; plant cells, etc. The selection of an appropriate host is deemed to be within the scope of those skilled in the art from the teachings herein.

Yeast, insect or mammalian cell hosts can also be used, employing suitable vectors and control sequences. Examples of mammalian expression systems include the COS-7 lines of monkey kidney fibroblasts, described by Gluzman, Cell 23:175 (1981), and other cell lines capable of expressing a compatible vector, for example, the C127, 3T3, CHO, HeLa and BHK cell lines.

Polynucleotides described herein can be administered and expressed in human cells (e.g., immune cells, including dendritic cells). A human codon usage table can be used to guide the codon choice for each amino acid. Such polynucleotides comprise spacer amino acid residues between epitopes and/or analogs, such as those described above, or can comprise naturally-occurring flanking sequences adjacent to the epitopes and/or analogs (and/or CTL (e.g., CD8$^+$), Th (e.g., CD4$^+$), and B cell epitopes).

Standard regulatory sequences well known to those of skill in the art can be included in the vector to ensure expression in the human target cells. Several vector elements are desirable: a promoter with a downstream cloning site for polynucleotide, e.g., minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences. In some embodiments, the promoter is the CMV-IE promoter.

Useful expression vectors for eukaryotic hosts, especially mammals or humans include, for example, vectors comprising expression control sequences from SV40, bovine papilloma virus, adenovirus and cytomegalovirus. Useful expression vectors for bacterial hosts include known bacterial plasmids, such as plasmids from *Escherichia coli*, including pCR1, pBR322, pMB9 and their derivatives, wider host range plasmids, such as M13 and filamentous single-stranded DNA phages.

Vectors may be introduced into animal tissues by a number of different methods. The two most popular approaches are injection of DNA in saline, using a standard hypodermic needle, and gene gun delivery. A schematic outline of the construction of a DNA vaccine plasmid and its subsequent delivery by these two methods into a host is illustrated at Scientific American (Weiner et al., (1999) Scientific American 281 (1): 34-41). Injection in saline is normally conducted intramuscularly (IM) in skeletal muscle, or intradermally (ID), with DNA being delivered to the extracellular spaces. This can be assisted by electroporation by temporarily damaging muscle fibers with myotoxins such as bupivacaine; or by using hypertonic solutions of saline or sucrose (Alarcon et al., (1999). Adv. Parasitol. Advances in Parasitology 42: 343-410). Immune responses to this method of delivery can be affected by many factors, including needle type, needle alignment, speed of injection, volume of injection, muscle type, and age, sex and physiological condition of the animal being injected (Alarcon et al., (1999). Adv. Parasitol. Advances in Parasitology 42: 343-410).

Gene gun delivery, the other commonly used method of delivery, ballistically accelerates plasmid DNA (pDNA) that has been adsorbed onto gold or tungsten microparticles into the target cells, using compressed helium as an accelerant (Alarcon et al., (1999). Adv. Parasitol. Advances in Parasitology 42: 343-410; Lewis et al., (1999). Advances in Virus Research (Academic Press) 54: 129-88).

Alternative delivery methods may include aerosol instillation of naked DNA on mucosal surfaces, such as the nasal and lung mucosa, (Lewis et al., (1999). Advances in Virus Research (Academic Press) 54: 129-88) and topical administration of pDNA to the eye and vaginal mucosa (Lewis et al., (1999) Advances in Virus Research (Academic Press) 54: 129-88). Mucosal surface delivery has also been achieved using cationic liposome-DNA preparations, biodegradable microspheres, attenuated *Shigella* or *Listeria* vectors for oral administration to the intestinal mucosa, and recombinant adenovirus vectors. DNA or RNA may also be delivered to cells following mild mechanical disruption of the cell membrane, temporarily permeabilizing the cells. Such a mild mechanical disruption of the membrane can be accomplished by gently forcing cells through a small aperture (Sharei et al., Ex Vivo Cytosolic Delivery of Functional Macromolecules to Immune Cells, PLOS ONE (2015)).

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). In the case where a non-viral delivery system is utilized, an exemplary delivery vehicle is a liposome. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., Glycobiology 5: 505-10 (1991)). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Choi") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol.

In some embodiments, a vector comprises a polynucleotide encoding a first peptide comprising a first neoepitope and a second peptide comprising a second neoepitope. In some embodiments, the first and second peptides are derived from the same protein. The at least two distinct peptides may vary by length, amino acid sequence or both. The peptides are derived from any protein known to or have been found to contain a tumor specific mutation. In some embodiments, a vector comprises a first peptide comprising a first neoepitope of a protein and a second peptide comprising a second neoepitope of the same protein, wherein the first peptide is different from the second peptide, and wherein the first neoepitope comprises a mutation and the second neoepitope comprises the same mutation. In some embodiments, a vector comprises a first peptide comprising a first neoepitope of a first region of a protein and a second peptide comprising a second neoepitope of a second region of the same protein, wherein the first region comprises at least one amino acid of the second region, wherein the first peptide is different from the second peptide and wherein the first neoepitope comprises a first mutation and the second neoepitope comprises a second mutation. In some embodiments, the first mutation and the second mutation are the same. In some embodiments, the mutation is selected from the group consisting of a point mutation, a splice-site mutation, a frameshift mutation, a read-through mutation, a gene fusion mutation and any combination thereof.

In some embodiments, a vector comprises a polynucleotide operably linked to a promoter. In some embodiments, the vector is a self-amplifying RNA replicon, plasmid, phage, transposon, cosmid, virus, or virion. In some embodiments, the vector is derived from a retrovirus, lentivirus, adenovirus, adeno-associated virus, herpes virus, pox virus, alpha virus, vaccinia virus, hepatitis B virus, human papillomavirus or a pseudotype thereof. In some embodiments, the vector is a non-viral vector. In some embodiments, the non-viral vector is a nanoparticle, a cationic lipid, a cationic polymer, a metallic nanopolymer, a nanorod, a liposome, a micelle, a microbubble, a cell-penetrating peptide, or a liposphere.

V. T Cell Receptors

In one aspect, the present disclosure provides cells expressing a neoantigen-recognizing receptor that activates an immunoresponsive cell (e.g., T cell receptor (TCR) or chimeric antigen receptor (CAR)), and methods of using such cells for the treatment of a disease that requires an enhanced immune response. Such cells include genetically modified immunoresponsive cells (e.g., T cells, Natural Killer (NK) cells, cytotoxic T lymphocytes (CTL (e.g., CD8$^+$)) cells, helper T lymphocyte (Th (e.g., CD4$^+$)) cells) expressing an antigen-recognizing receptor (e.g., TCR or CAR) that binds one of the neoantigenic peptides described herein, and methods of use therefore for the treatment of neoplasia and other pathologies where an increase in an antigen-specific immune response is desired. T cell activation is mediated by a TCR or a CAR targeted to an antigen.

The present disclosure provides cells expressing a combination of an antigen-recognizing receptor that activates an immunoresponsive cell (e.g., TCR, CAR) and a chimeric co-stimulating receptor (CCR), and methods of using such cells for the treatment of a disease that requires an enhanced immune response. In some embodiments, tumor antigen-specific T cells, NK cells, CTL cells or other immunoresponsive cells are used as shuttles for the selective enrichment of one or more co-stimulatory ligands for the treatment or prevention of neoplasia. Such cells are administered to a human subject in need thereof for the treatment or prevention of a particular cancer.

In some embodiments, the tumor antigen-specific human lymphocytes that can be used in the methods of the present disclosure include, without limitation, peripheral donor lymphocytes genetically modified to express chimeric antigen receptors (CARs) (Sadelain, M., et al. 2003 Nat Rev Cancer 3:35-45), peripheral donor lymphocytes genetically modified to express a full-length tumor antigen-recognizing T cell receptor complex comprising the a and p heterodimer (Morgan, R. A., et al. 2006 Science 314:126-129), lymphocyte cultures derived from tumor infiltrating lymphocytes (TILs) in tumor biopsies (Panelli, M. C., et al. 2000 J Immunol 164:495-504; Panelli, M. C., et al. 2000 J Immunol 164: 4382-4392), and selectively in vitro-expanded antigen-specific peripheral blood leukocytes employing artificial antigen-presenting cells (AAPCs) or pulsed dendritic cells (Dupont, J., et al. 2005 Cancer Res 65:5417-5427; Papanicolaou, G. A., et al. 2003 Blood 102:2498-2505). The T cells may be autologous, allogeneic, or derived in vitro from engineered progenitor or stem cells.

In some embodiments, the immunotherapeutic is an engineered receptor. In some embodiments, the engineered receptor is a chimeric antigen receptor (CAR), a T cell receptor (TCR), or a B-cell receptor (BCR), an adoptive T cell therapy (ACT), or a derivative thereof. In other aspects, the engineered receptor is a chimeric antigen receptor (CAR). In some aspects, the CAR is a first generation CAR. In other aspects, the CAR is a second generation CAR. In still other aspects, the CAR is a third generation CAR. In some aspects, the CAR comprises an extracellular portion, a transmembrane portion, and an intracellular portion. In some aspects, the intracellular portion comprises at least one T cell co-stimulatory domain. In some aspects, the T cell co-stimulatory domain is selected from the group consisting of CD27, CD28, TNFRS9 (4-1BB), TNFRSF4 (OX40), TNFRSF8 (CD30), CD40LG (CD40L), ICOS, ITGB2 (LFA-1), CD2, CD7, KLRC2 (NKG2C), TNFRS18 (GITR), TNFRSF14 (HVEM), or any combination thereof.

In some aspects, the engineered receptor binds a target. In some aspects, the binding is specific to a peptide specific to one or more subjects suffering from a disease or condition.

In some aspects, the immunotherapeutic is a cell as described in detail herein. In some aspects, the immunotherapeutic is a cell comprising a receptor that specifically binds a peptide or neoepitope described herein. In some aspects, the immunotherapeutic is a cell used in combination with the peptides/nucleic acids of the present disclosure. In some embodiments, the cell is a patient cell. In some embodiments, the cell is a T cell. In some embodiments, the cell is tumor infiltrating lymphocyte.

In some aspects, a subject with a condition or disease is treated based on a T cell receptor repertoire of the subject. In some embodiments, a peptide or neoepitope is selected based on a T cell receptor repertoire of the subject. In some embodiments, a subject is treated with T cells expressing TCRs specific to a peptide or neoepitope as described herein. In some embodiments, a subject is treated with a peptide or neoepitope specific to TCRs, e.g., subject specific TCRs. In some embodiments, a subject is treated with a peptide or neoepitope specific to T cells expressing TCRs, e.g., subject specific TCRs. In some embodiments, a subject is treated with a peptide or neoepitope specific to subject specific TCRs.

In some embodiments, the composition as described herein is selected based on TCRs identified in one or more subjects. In some embodiments, identification of a T cell repertoire and testing in functional assays is used to determine the composition to be administered to one or more subjects with a condition or disease. In some embodiments, the composition is an antigen vaccine comprising one or more peptides or proteins as described herein. In some embodiments, the vaccine comprises subject specific neoantigenic peptides. In some embodiments, the peptides to be included in the vaccine are selected based on a quantification of subject specific TCRs that bind to the neoepitopes. In some embodiments, the peptides are selected based on a binding affinity of the peptide to a TCR. In some embodiments, the selecting is based on a combination of both the quantity and the binding affinity. For example, a TCR that binds strongly to a neoepitope in a functional assay, but that is not highly represented in a TCR repertoire may be a good candidate for an antigen vaccine because T cells expressing the TCR would be advantageously amplified.

In some embodiments, the peptide or protein is selected for administering to one or more subjects based on binding to TCRs. In some embodiments, T cells, such as T cells from a subject with a disease or condition, can be expanded. Expanded T cells that express TCRs specific to a neoantigenic peptide or neoepitope can be administered back to a subject. In some embodiments, suitable cells, e.g., PBMCs, are transduced or transfected with polynucleotides for expression of TCRs specific to a neoantigenic peptide or neoepitope and administered to a subject. T cells expressing TCRs specific to a neoantigenic peptide or neoepitope can be expanded and administered back to a subject. In some embodiments, T cells that express TCRs specific to a neoantigenic peptide or neoepitope that result in cytolytic activity when incubated with autologous diseased tissue can be expanded and administered to a subject. In some embodiments, T cells used in functional assays result in binding to a neoantigenic peptide or neoepitope can be expanded and administered to a subject. In some embodiments, TCRs that have been determined to bind to subject specific neoantigenic peptides or neoepitopes can be expressed in T cells and administered to a subject.

In an embodiment, the present disclosure provides a composition comprising a first peptide comprising a first neoepitope and a second peptide comprising a second neoepitope, wherein the first peptide is different from the second peptide, and wherein the first neoepitope comprises a mutation and the second neoepitope comprises the same mutation. In some embodiments, the composition as provided herein comprises a first T cell comprising a first T cell receptor (TCR) specific for the first neoepitope and a second T cell comprising a second TCR specific for the second neoepitope. In some embodiments, the first and second peptides are derived from the same protein.

In another embodiment, the present disclosure provides a composition comprising a first peptide comprising a first neoepitope of a first region of a protein and a second peptide comprising a second neoepitope of a second region of the same protein, wherein the first region comprises at least one amino acid of the second region, wherein the first peptide is different from the second peptide and wherein the first neoepitope comprises a first mutation and the second neoepitope comprises a second mutation. In some embodiments, the composition as provided herein comprises a first T cell comprising a first T cell receptor (TCR) specific for the first neoepitope and a second T cell comprising a second TCR specific for the second neoepitope. In some embodiments, the first mutation and the second mutation are the same.

In some embodiments, the first neoepitope binds to a class I HLA protein to form a class I HLA-peptide complex. In some embodiments, the first neoepitope binds to a class II HLA protein to form a class II HLA-peptide complex. In some embodiments, the second neoepitope binds to a class II HLA a protein to form a class II HLA-peptide complex. In some embodiments, the second neoepitope binds to a class I HLA protein to form a class I HLA-peptide complex. In some embodiments, the first neoepitope activates $CD8^+$ T cells. In some embodiments, the first neoepitope activates CD4+ T cells. In some embodiments, the second neoepitope activates CD4+ T cells. In some embodiments, the second neoepitope activates CD8+ T cells. In some embodiments, a TCR of a CD4+ T cell binds to a class II HLA-peptide complex. In some embodiments, a TCR of a CD8+ T cell binds to a class II HLA-peptide complex. In some embodiments, a TCR of a CD8+ T cell binds to a class I HLA-peptide complex. In some embodiments, a TCR of a CD4 T cell binds to a class I HLA-peptide complex.

In some embodiments, the first TCR is a first chimeric antigen receptor specific for the first neoepitope and the second TCR is a second chimeric antigen receptor specific for the second neoepitope. In some embodiments, the first T cell is a cytotoxic T cell. In some embodiments, the first T cell is a gamma delta T cell. In some embodiments, the second T cell is a helper T cell. In some embodiments, the first and/or second TCR binds to an HLA-peptide complex with a $K_D$ or an $IC_{50}$ of less than 1,000 nM, 900 nM, 800 nM, 700 nM, 600 nM, 500 nM, 250 nM, 150 nM, 100 nM, 50 nM, 25 nM or 10 nM. In some embodiments, the first and/or second TCR binds to an HLA class I-peptide complex with a $K_D$ or an $IC_{50}$ of less than 1,000 nM, 900 nM, 800 nM, 700 nM, 600 nM, 500 nM, 250 nM, 150 nM, 100 nM, 50 nM, 25 nM or 10 nM. In some embodiments, the first and/or second TCR binds to an HLA class II-peptide complex with a $K_D$ or an $IC_{50}$ of less than 2,000, 1,500, 1,000 nM, 900 nM, 800 nM, 700 nM, 600 nM, 500 nM, 250 nM, 150 nM, 100 nM, 50 nM, 25 nM or 10 nM.

VI. Antigen Presenting Cells

The neoantigenic peptide or protein can be provided as antigen presenting cells (e.g., dendritic cells) containing such peptides, proteins or polynucleotides as described herein. In other embodiments, such antigen presenting cells are used to stimulate T cells for use in patients. Thus, one embodiment of the present disclosure is a composition containing at least one antigen presenting cell (e.g., a dendritic cell) that is pulsed or loaded with one or more neoantigenic peptides or polynucleotides described herein. In some embodiments, such APCs are autologous (e.g., autologous dendritic cells). Alternatively, peripheral blood mononuclear cells (PBMCs) isolated from a patient can be loaded with neoantigenic peptides or polynucleotides ex vivo. In related embodiments, such APCs or PBMCs are injected back into the patient. In some embodiments, the antigen presenting cells are dendritic cells. In related embodiments, the dendritic cells are autologous dendritic cells that are pulsed with the neoantigenic peptide or nucleic acid. The neoantigenic peptide can be any suitable peptide that gives rise to an appropriate T cell response. T cell therapy using autologous dendritic cells pulsed with peptides from a tumor associated antigen is disclosed in Murphy et al. (1996) The Prostate 29, 371-380 and Tjua et al. (1997) The Prostate 32, 272-278. In some embodiments, the T cell is a CTL (e.g., CD8+). In some embodiments, the T cell is a helper T lymphocyte (Th (e.g., CD4+)).

In some embodiments, the present disclosure provides a composition comprising a cell-based immunogenic pharmaceutical composition that can also be administered to a subject. For example, an antigen presenting cell (APC) based immunogenic pharmaceutical composition can be formulated using any of the well-known techniques, carriers, and excipients as suitable and as understood in the art. APCs include monocytes, monocyte-derived cells, macrophages, and dendritic cells. Sometimes, an APC based immunogenic pharmaceutical composition can be a dendritic cell-based immunogenic pharmaceutical composition.

A dendritic cell-based immunogenic pharmaceutical composition can be prepared by any methods well known in the art. In some cases, dendritic cell-based immunogenic pharmaceutical compositions can be prepared through an ex vivo or in vivo method. The ex vivo method can comprise the use of autologous DCs pulsed ex vivo with the polypeptides described herein, to activate or load the DCs prior to administration into the patient. The in vivo method can comprise targeting specific DC receptors using antibodies coupled with the polypeptides described herein. The DC-based immunogenic pharmaceutical composition can further comprise DC activators such as TLR3, TLR-7-8, and CD40 agonists. The DC-based immunogenic pharmaceutical composition can further comprise adjuvants, and a pharmaceutically acceptable carrier.

Antigen presenting cells (APCs) can be prepared from a variety of sources, including human and non-human primates, other mammals, and vertebrates. In certain embodiments, APCs can be prepared from blood of a human or non-human vertebrate. APCs can also be isolated from an enriched population of leukocytes. Populations of leukocytes can be prepared by methods known to those skilled in the art. Such methods typically include collecting heparinized blood, apheresis or leukopheresis, preparation of buffy coats, rosetting, centrifugation, density gradient centrifugation (e.g., using Ficoll, colloidal silica particles, and sucrose), differential lysis non-leukocyte cells, and filtration. A leukocyte population can also be prepared by collecting blood from a subject, defibrillating to remove the platelets and lysing the red blood cells. The leukocyte population can optionally be enriched for monocytic dendritic cell precursors.

Blood cell populations can be obtained from a variety of subjects, according to the desired use of the enriched population of leukocytes. The subject can be a healthy subject. Alternatively, blood cells can be obtained from a subject in need of immunostimulation, such as, for example, a cancer patient or other patient for which immunostimulation will be beneficial. Likewise, blood cells can be obtained from a subject in need of immune suppression, such as, for example, a patient having an autoimmune disorder (e.g., rheumatoid arthritis, diabetes, lupus, multiple sclerosis, and the like). A population of leukocytes also can be obtained from an HLA-matched healthy individual.

When blood is used as a source of APC, blood leukocytes may be obtained using conventional methods that maintain their viability. According to one aspect of the present disclosure, blood can be diluted into medium that may or may not contain heparin or other suitable anticoagulant. The volume of blood to medium can be about 1 to 1. Cells can be concentrated by centrifugation of the blood in medium at about 1,000 rpm (150 g) at 4° C. Platelets and red blood cells can be depleted by resuspending the cells in any number of solutions known in the art that will lyse erythrocytes, for example ammonium chloride. For example, the mixture may be medium and ammonium chloride at about 1:1 by volume. Cells may be concentrated by centrifugation and washed in the desired solution until a population of leukocytes, substantially free of platelets and red blood cells, is obtained. Any isotonic solution commonly used in tissue culture may be used as the medium for separating blood leukocytes from platelets and red blood cells. Examples of such isotonic solutions can be phosphate buffered saline, Hanks balanced salt solution, and complete growth media. APCs and/or APC precursor cells may also purified by elutriation.

In one embodiment, the APCs can be non-nominal APCs under inflammatory or otherwise activated conditions. For example, non-nominal APCs can include epithelial cells stimulated with interferon-gamma, T cells, B cells, and/or monocytes activated by factors or conditions that induce APC activity. Such non-nominal APCs can be prepared according to methods known in the art.

The APCs can be cultured, expanded, differentiated and/or, matured, as desired, according to the according to the type of APC. The APCs can be cultured in any suitable culture vessel, such as, for example, culture plates, flasks, culture bags, and bioreactors.

In certain embodiments, APCs can be cultured in suitable culture or growth medium to maintain and/or expand the number of APCs in the preparation. The culture media can be selected according to the type of APC isolated. For example, mature APCs, such as mature dendritic cells, can be cultured in growth media suitable for their maintenance and expansion. The culture medium can be supplemented with amino acids, vitamins, antibiotics, divalent cations, and the like. In addition, cytokines, growth factors and/or hormones, can be included in the growth media. For example, for the maintenance and/or expansion of mature dendritic cells, cytokines, such as granulocyte/macrophage colony stimulating factor (GM-CSF), FMS-like tyrosine kinase 3 ligand (FLT-3L) and/or interleukin 4 (IL-4), can be added. In other embodiments, immature APCs can be cultured and/or expanded. Immature dendritic cells can they retain the ability to uptake target mRNA and process new antigen. In some embodiments, immature dendritic cells can be cultured in media suitable for their maintenance and culture. The culture medium can be supplemented with amino acids, vitamins, antibiotics, divalent cations, and the like. In addition, cytokines, growth factors and/or hormones, can be included in the growth media.

Other immature APCs can similarly be cultured or expanded. Preparations of immature APCs can be matured to form mature APCs. Maturation of APCs can occur during or following exposure to the neoantigenic peptides. In certain embodiments, preparations of immature dendritic cells can be matured. Suitable maturation factors include, for example, cytokines TNF-α, bacterial products (e.g., BCG), and the like. In another aspect, isolated APC precursors can be used to prepare preparations of immature APCs. APC precursors can be cultured, differentiated, and/or matured. In certain embodiments, monocytic dendritic cell precursors can be cultured in the presence of suitable culture media supplemented with amino acids, vitamins, cytokines, and/or divalent cations, to promote differentiation of the monocytic dendritic cell precursors to immature dendritic cells. In some embodiments, the APC precursors are isolated from PBMCs. The PBMCs can be obtained from a donor, for example, a human donor, and can be used freshly or frozen for future usage. In some embodiments, the APC is prepared from one or more APC preparations. In some embodiments, the APC comprises an APC loaded with the first and second neoantigenic peptides comprising the first and second neoepitopes or polynucleotides encoding the first and second neoantigenic peptides comprising the first and second neoepitopes. In some embodiments, the APC is an autologous APC, an allogenic APC, or an artificial APC.

In an embodiment, the present disclosure provides a composition comprising an APC comprising a first peptide comprising a first neoepitope and a second peptide comprising a second neoepitope, wherein the first peptide is different from the second peptide, and wherein the first neoepitope comprises a mutation and the second neoepitope comprises the same mutation. In some embodiments, the first and second peptides are derived from the same protein. In another embodiment, the present disclosure provides a composition comprising an APC comprising a first peptide comprising a first neoepitope of a first region of a protein and a second peptide comprising a second neoepitope of a second region of the same protein, wherein the first region comprises at least one amino acid of the second region, wherein the first peptide is different from the second peptide and wherein the first neoepitope comprises a first mutation and the second neoepitope comprises a second mutation. In some embodiments, the first mutation and the second mutation are the same.

VII. Adjuvants

An adjuvant can be used to enhance the immune response (humoral and/or cellular) elicited in a patient receiving a composition as provided herein. Sometimes, adjuvants can elicit a Th1-type response. Other times, adjuvants can elicit a Th2-type response. A Th1-type response can be characterized by the production of cytokines such as IFN-γ as opposed to a Th2-type response which can be characterized by the production of cytokines such as IL-4, IL-5 and IL-10.

In some aspects, lipid-based adjuvants, such as MPLA and MDP, can be used with the immunogenic pharmaceutical compositions disclosed herein. Monophosphoryl lipid A (MPLA), for example, is an adjuvant that causes increased presentation of liposomal antigen to specific T Lymphocytes. In addition, a muramyl dipeptide (MDP) can also be used as a suitable adjuvant in conjunction with the immunogenic pharmaceutical formulations described herein.

Suitable adjuvants are known in the art (see, WO 2015/095811) and include, but are not limited to poly(I:C), poly-ICLC, Hiltonol, STING agonist, 1018 ISS, aluminum salts, Amplivax, AS15, BCG, CP-870,893, CpG7909, CyaA, dSLIM, GM-CSF, FLT-3L, IC30, IC31, Imiquimod, ImuFact IMP321, IS Patch, ISS, ISCOMATRIX, JuvImmune, LipoVac, MF59, monophosphoryl lipid A, Montanide IMS 1312, Montanide ISA 206, Montanide ISA 50V, Montanide ISA-51, OK-432, OM-174, OM-197-MP-EC, ONTAK, PepTel®. vector system, PLG microparticles, resiquimod, SRL172, virosomes and other virus-like particles, YF-17D, VEGF trap, R848, beta-glucan, Pam3Cys, Pam3CSK4, Aquila's QS21 stimulon (Aquila Biotech, Worcester, Mass., USA) which is derived from saponin, mycobacterial extracts and synthetic bacterial cell wall mimics, and other proprietary adjuvants such as Ribi's Detox. Quil or Superfos. Adjuvants also include incomplete Freund's or GM-CSF. Several immunological adjuvants (e.g., MF59) specific for dendritic cells and their preparation have been described previously (Dupuis M, et al., Cell Immunol. 1998; 186(1): 18-27; Allison A C; Dev. Biol. Stand. 1998; 92:3-11) (Mosca et al. Frontiers in Bioscience, 2007; 12:4050-4060) (Gamvrellis et al. Immunol & Cell Biol. 2004; 82: 506-516). Also cytokines can be used. Several cytokines have been directly linked to influencing dendritic cell migration to lymphoid tissues (e.g., TNF-alpha), accelerating the maturation of dendritic cells into efficient antigen-presenting cells for T-lymphocytes (e.g., GM-CSF, FLT-3L, PGE1, PGE2, IL-1, IL-1b, IL-4, IL-6 and CD40L) (U.S. Pat. No. 5,849,589 incorporated herein by reference in its entirety) and acting as immunoadjuvants (e.g., IL-12) (Gabrilovich D I, et al., J. Immunother. Emphasis Tumor Immunol. 1996 (6): 414-418).

Adjuvant can also comprise stimulatory molecules such as cytokines. Non-limiting examples of cytokines include:

CCL20, a-interferon (IFN-a), β-interferon (IFN-β), γ-interferon, platelet derived growth factor (PDGF), TNFα, TNFβ (lymphotoxin alpha (LTα)), GM-CSF, FLT-3L, epidermal growth factor (EGF), cutaneous T cell-attracting chemokine (CTACK), epithelial thymus-expressed chemokine (TECK), mucosae-associated epithelial chemokine (MEC), IL-12, IL-15, IL-28, MHC, CD80, CD86, IL-1, IL-2, IL-4, IL-5, IL-6, IL-10, IL-18, MCP-1, MIP-1a, MIP-1-, IL-8, L-selectin, P-selectin, α-selectin, CD34, GlyCAM-1, MadCAM-1, LFA-1, VLA-1, Mac-1, p150.95, PECAM, ICAM-1, ICAM-2, ICAM-3, CD2, LFA-3, M-CSF, G-CSF, mutant forms of IL-18, CD40, CD40L, vascular growth factor, fibroblast growth factor, IL-7, nerve growth factor, vascular endothelial growth factor, Fas, TNF receptor, Flt, Apo-1, p55, WSL-1, DR3, TRAMP, Apo-3, AIR, LARD, NGRF, DR4, DR5, KILLER, TRAIL-R2, TRICK2, DR6, Caspase ICE, Fos, c-jun, Sp-1, Ap-1, Ap-2, p38, p65Rel, MyD88, IRAK, TRAF6, IκB, Inactive NIK, SAP K, SAP-I, JNK, interferon response genes, NFκB, Bax, TRAIL, TRAILrec, TRAIL-recDRC5, TRAIL-R3, TRAIL-R4, RANK, RANK LIGAND, Ox40, Ox40 LIGAND, NKG2D, MICA, MICB, NKG2A, NKG2B, NKG2C, NKG2E, NKG2F, TAP1, and TAP2.

Additional adjuvants include: MCP-1, MIP-1a, MIP-1p, IL-8, RANTES, L-selectin, P-selectin, E-selectin, CD34, GlyCAM-1, MadCAM-1, LFA-1, VLA-1, Mac-1, p150.95, PECAM, ICAM-1, ICAM-2, ICAM-3, CD2, LFA-3, M-CSF, G-CSF, IL-4, mutant forms of IL-18, CD40, CD40L, vascular growth factor, fibroblast growth factor, IL-7, IL-22, nerve growth factor, vascular endothelial growth factor, Fas, TNF receptor, Flt, Apo-1, p55, WSL-1, DR3, TRAMP, Apo-3, AIR, LARD, NGRF, DR4, DR5, KILLER, TRAIL-R2, TRICK2, DR6, Caspase ICE, Fos, c-jun, Sp-1, Ap-1, Ap-2, p38, p65Rel, MyD88, IRAK, TRAF6, IκB, Inactive NIK, SAP K, SAP-1, JNK, interferon response genes, NFκB, Bax, TRAIL, TRAILrec, TRAIL-recDRC5, TRAIL-R3, TRAIL-R4, RANK, RANK LIGAND, Ox40, Ox40 LIGAND, NKG2D, MICA, MICB, NKG2A, NKG2B, NKG2C, NKG2E, NKG2F, TAP1, TAP2 and functional fragments thereof.

In some aspects, an adjuvant can be a modulator of a toll like receptor. Examples of modulators of toll-like receptors include TLR-9 agonists and are not limited to small molecule modulators of toll-like receptors such as Imiquimod. Other examples of adjuvants that are used in combination with an immunogenic pharmaceutical composition described herein can include and are not limited to saponin, CpG ODN and the like. Sometimes, an adjuvant is selected from bacteria toxoids, polyoxypropylene-polyoxyethylene block polymers, aluminum salts, liposomes, CpG polymers, oil-in-water emulsions, or a combination thereof. Sometimes, an adjuvant is an oil-in-water emulsion. The oil-in-water emulsion can include at least one oil and at least one surfactant, with the oil(s) and surfactant(s) being biodegradable (metabolisable) and biocompatible. The oil droplets in the emulsion can be less than 5 µm in diameter, and can even have a sub-micron diameter, with these small sizes being achieved with a microfluidiser to provide stable emulsions. Droplets with a size less than 220 nm can be subjected to filter sterilization.

VIII. Methods of Treatment and Pharmaceutical Compositions

The neoantigen therapeutics (e.g., peptides, polynucleotides, TCR, CAR, cells containing TCR or CAR, APC or dendritic cell containing polypeptide, dendritic cell containing polynucleotide, antibody, etc.) described herein are useful in a variety of applications including, but not limited to, therapeutic treatment methods, such as the treatment of cancer. In some embodiments, the therapeutic treatment methods comprise immunotherapy. In certain embodiments, a neoantigenic peptide is useful for activating, promoting, increasing, and/or enhancing an immune response, redirecting an existing immune response to a new target, increasing the immunogenicity of a tumor, inhibiting tumor growth, reducing tumor volume, increasing tumor cell apoptosis, and/or reducing the tumorigenicity of a tumor. The methods of use can be in vitro, ex vivo, or in vivo methods.

In some aspects, the present disclosure provides methods for activating an immune response in a subject using a neoantigenic peptide or protein described herein. In some embodiments, the present disclosure provides methods for promoting an immune response in a subject using a neoantigenic peptide described herein. In some embodiments, the present disclosure provides methods for increasing an immune response in a subject using a neoantigenic peptide described herein. In some embodiments, the present disclosure provides methods for enhancing an immune response using a neoantigenic peptide. In some embodiments, the activating, promoting, increasing, and/or enhancing of an immune response comprises increasing cell-mediated immunity. In some embodiments, the activating, promoting, increasing, and/or enhancing of an immune response comprises increasing T cell activity or humoral immunity. In some embodiments, the activating, promoting, increasing, and/or enhancing of an immune response comprises increasing CTL or Th activity. In some embodiments, the activating, promoting, increasing, and/or enhancing of an immune response comprises increasing NK cell activity. In some embodiments, the activating, promoting, increasing, and/or enhancing of an immune response comprises increasing T cell activity and increasing NK cell activity. In some embodiments, the activating, promoting, increasing, and/or enhancing of an immune response comprises increasing CTL activity and increasing NK cell activity. In some embodiments, the activating, promoting, increasing, and/or enhancing of an immune response comprises inhibiting or decreasing the suppressive activity of T regulatory (Treg) cells. In some embodiments, the immune response is a result of antigenic stimulation. In some embodiments, the antigenic stimulation is a tumor cell. In some embodiments, the antigenic stimulation is cancer.

In some embodiments, the present disclosure provides methods of activating, promoting, increasing, and/or enhancing of an immune response using a neoantigenic peptide described herein. In some embodiments, a method comprises administering to a subject in need thereof a therapeutically effective amount of a neoantigenic peptide that delivers a neoantigenic peptide or polynucleotide to a tumor cell. In some embodiments, a method comprises administering to a subject in need thereof a therapeutically effective amount of a neoantigenic peptide internalized by the tumor cell. In some embodiments, a method comprises administering to a subject in need thereof a therapeutically effective amount of a neoantigenic peptide that is internalized by a tumor cell, and the neoantigenic peptide is processed by the cell. In some embodiments, a method comprises administering to a subject in need thereof a therapeutically effective amount of a neoantigenic polypeptide that is internalized by a tumor cell and a neoepitope is presented on the surface of the tumor cell. In some embodiments, a method comprises administering to a subject in need thereof a therapeutically effective amount of a neoantigenic polypeptide that is internalized by the tumor cell, is processed by the cell, and an antigenic peptide is presented on the surface of the tumor cell.

In some embodiments, a method comprises administering to a subject in need thereof a therapeutically effective amount of a neoantigenic peptide or polynucleotide described herein that delivers an exogenous polypeptide comprising at least one neoantigenic peptide to a tumor cell, wherein at least one neoepitope derived from the neoantigenic peptide is presented on the surface of the tumor cell. In some embodiments, the antigenic peptide is presented on the surface of the tumor cell in complex with a MHC class I molecule. In some embodiments, the neoepitope is presented on the surface of the tumor cell in complex with a MHC class II molecule.

In some embodiments, a method comprises contacting a tumor cell with a neoantigenic polypeptide or polynucleotide described herein that delivers an exogenous polypeptide comprising at least one neoantigenic peptide to the tumor cell, wherein at least one neoepitope derived from the at least one neoantigenic peptide is presented on the surface of the tumor cell. In some embodiments, the neoepitope is presented on the surface of the tumor cell in complex with a MHC class I molecule. In some embodiments, the neoepitope is presented on the surface of the tumor cell in complex with a MHC class II molecule.

In some embodiments, a method comprises administering to a subject in need thereof a therapeutically effective amount of a neoantigenic polypeptide or polynucleotide described herein that delivers an exogenous polypeptide comprising at least one antigenic peptide to a tumor cell, wherein the neoepitope is presented on the surface of the tumor cell, and an immune response against the tumor cell is induced. In some embodiments, the immune response against the tumor cell is increased. In some embodiments, the neoantigenic polypeptide or polynucleotide delivers an exogenous polypeptide comprising at least one neoantigenic peptide to a tumor cell, wherein the neoepitope is presented on the surface of the tumor cell, and tumor growth is inhibited.

In some embodiments, a method comprises administering to a subject in need thereof a therapeutically effective amount of a neoantigenic polypeptide or polynucleotide described herein that delivers an exogenous polypeptide comprising at least one neoantigenic peptide to a tumor cell, wherein the neoepitope derived from the at least one neoantigenic peptide is presented on the surface of the tumor cell, and T cell killing directed against the tumor cell is induced. In some embodiments, T cell killing directed against the tumor cell is enhanced. In some embodiments, T cell killing directed against the tumor cell is increased.

In some embodiments, a method of increasing an immune response in a subject comprises administering to the subject a therapeutically effective amount of a neoantigenic therapeutic described herein, wherein the agent is an antibody that specifically binds the neoantigen described herein. In some embodiments, a method of increasing an immune response in a subject comprises administering to the subject a therapeutically effective amount of the antibody.

The present disclosure provides methods of redirecting an existing immune response to a tumor. In some embodiments, a method of redirecting an existing immune response to a tumor comprises administering to a subject a therapeutically effective amount of a neoantigen therapeutic described herein. In some embodiments, the existing immune response is against a virus. In some embodiments, the virus is selected from the group consisting of: measles virus, varicella-zoster virus (VZV; chickenpox virus), influenza virus, mumps virus, poliovirus, rubella virus, rotavirus, hepatitis A virus (HAV), hepatitis B virus (HBV), Epstein Barr virus (EBV), and cytomegalovirus (CMV). In some embodiments, the virus is varicella-zoster virus. In some embodiments, the virus is cytomegalovirus. In some embodiments, the virus is measles virus. In some embodiments, the existing immune response has been acquired after a natural viral infection. In some embodiments, the existing immune response has been acquired after vaccination against a virus. In some embodiments, the existing immune response is a cell-mediated response. In some embodiments, the existing immune response comprises cytotoxic T cells (CTLs) or Th cells.

In some embodiments, a method of redirecting an existing immune response to a tumor in a subject comprises administering a fusion protein comprising (i) an antibody that specifically binds a neoantigen and (ii) at least one neoantigenic peptide described herein, wherein (a) the fusion protein is internalized by a tumor cell after binding to the tumor-associated antigen or the neoepitope; (b) the neoantigenic peptide is processed and presented on the surface of the tumor cell associated with a MHC class I molecule; and (c) the neoantigenic peptide/MHC Class I complex is recognized by cytotoxic T cells. In some embodiments, the cytotoxic T cells are memory T cells. In some embodiments, the memory T cells are the result of a vaccination with the neoantigenic peptide.

The present disclosure provides methods of increasing the immunogenicity of a tumor. In some embodiments, a method of increasing the immunogenicity of a tumor comprises contacting a tumor or tumor cells with an effective amount of a neoantigen therapeutic described herein. In some embodiments, a method of increasing the immunogenicity of a tumor comprises administering to a subject a therapeutically effective amount of a neoantigen therapeutic described herein.

The present disclosure also provides methods for inhibiting growth of a tumor using a neoantigen therapeutic described herein. In certain embodiments, a method of inhibiting growth of a tumor comprises contacting a cell mixture with a neoantigen therapeutic in vitro. For example, an immortalized cell line or a cancer cell line mixed with immune cells (e.g., T cells) is cultured in medium to which a neoantigenic peptide is added. In some embodiments, tumor cells are isolated from a patient sample, for example, a tissue biopsy, pleural effusion, or blood sample, mixed with immune cells (e.g., T cells), and cultured in medium to which a neoantigen therapeutic is added. In some embodiments, a neoantigen therapeutic increases, promotes, and/or enhances the activity of the immune cells. In some embodiments, a neoantigen therapeutic inhibits tumor cell growth. In some embodiments, a neoantigen therapeutic activates killing of the tumor cells.

In certain embodiments, the subject is a human. In certain embodiments, the subject has a tumor or the subject had a tumor which was at least partially removed.

In some embodiments, a method of inhibiting growth of a tumor comprises redirecting an existing immune response to a new target, comprising administering to a subject a therapeutically effective amount of a neoantigen therapeutic, wherein the existing immune response is against an antigenic peptide delivered to the tumor cell by the neoantigenic peptide.

In certain embodiments, the tumor comprises cancer stem cells. In certain embodiments, the frequency of cancer stem cells in the tumor is reduced by administration of the neoantigen therapeutic. In some embodiments, a method of reducing the frequency of cancer stem cells in a tumor in a subject, comprising administering to the subject a therapeutically effective amount of a neoantigen therapeutic is provided.

In addition, in some aspects the present disclosure provides a method of reducing the tumorigenicity of a tumor in a subject, comprising administering to the subject a therapeutically effective amount of a neoantigen therapeutic described herein. In certain embodiments, the tumor comprises cancer stem cells. In some embodiments, the tumorigenicity of a tumor is reduced by reducing the frequency of cancer stem cells in the tumor. In some embodiments, the methods comprise using the neoantigen therapeutic described herein. In certain embodiments, the frequency of cancer stem cells in the tumor is reduced by administration of a neoantigen therapeutic described herein.

In some embodiments, the tumor is a solid tumor. In certain embodiments, the tumor is a tumor selected from the group consisting of: colorectal tumor, pancreatic tumor, lung tumor, ovarian tumor, liver tumor, breast tumor, kidney tumor, prostate tumor, neuroendocrine tumor, gastrointestinal tumor, melanoma, cervical tumor, bladder tumor, glioblastoma, and head and neck tumor. In certain embodiments, the tumor is a colorectal tumor. In certain embodiments, the tumor is an ovarian tumor. In some embodiments, the tumor is a breast tumor. In some embodiments, the tumor is a lung tumor. In certain embodiments, the tumor is a pancreatic tumor. In certain embodiments, the tumor is a melanoma tumor. In some embodiments, the tumor is a solid tumor.

The present disclosure further provides methods for treating cancer in a subject comprising administering to the subject a therapeutically effective amount of a neoantigen therapeutic described herein.

In some embodiments, a method of treating cancer comprises redirecting an existing immune response to a new target, the method comprising administering to a subject a therapeutically effective amount of neoantigen therapeutic, wherein the existing immune response is against an antigenic peptide delivered to the cancer cell by the neoantigenic peptide.

The present disclosure provides for methods of treating cancer comprising administering to a subject a therapeutically effective amount of a neoantigen therapeutic described herein (e.g., a subject in need of treatment). In certain embodiments, the subject is a human. In certain embodiments, the subject has a cancerous tumor. In certain embodiments, the subject has had a tumor at least partially removed.

Subjects can be, for example, mammal, humans, pregnant women, elderly adults, adults, adolescents, pre-adolescents, children, toddlers, infants, newborn, or neonates. A subject can be a patient. In some cases, a subject can be a human. In some cases, a subject can be a child (i.e. a young human being below the age of puberty). In some cases, a subject can be an infant. In some cases, the subject can be a formula-fed infant. In some cases, a subject can be an individual enrolled in a clinical study. In some cases, a subject can be a laboratory animal, for example, a mammal, or a rodent. In some cases, the subject can be a mouse. In some cases, the subject can be an obese or overweight subject.

In some embodiments, the subject has previously been treated with one or more different cancer treatment modalities. In some embodiments, the subject has previously been treated with one or more of radiotherapy, chemotherapy, or immunotherapy. In some embodiments, the subject has been treated with one, two, three, four, or five lines of prior therapy. In some embodiments, the prior therapy is a cytotoxic therapy.

In certain embodiments, the cancer is a cancer selected from the group consisting of colorectal cancer, pancreatic cancer, lung cancer, ovarian cancer, liver cancer, breast cancer, kidney cancer, prostate cancer, gastrointestinal cancer, melanoma, cervical cancer, neuroendocrine cancer, bladder cancer, glioblastoma, and head and neck cancer. In certain embodiments, the cancer is pancreatic cancer. In certain embodiments, the cancer is ovarian cancer. In certain embodiments, the cancer is colorectal cancer. In certain embodiments, the cancer is breast cancer. In certain embodiments, the cancer is prostate cancer. In certain embodiments, the cancer is lung cancer. In certain embodiments, the cancer is melanoma. In some embodiments, the cancer is a solid cancer. In some embodiments, the cancer comprises a solid tumor.

In some embodiments, the cancer is a hematologic cancer. In some embodiment, the cancer is selected from the group consisting of: acute myelogenous leukemia (AML), Hodgkin lymphoma, multiple myeloma, T cell acute lymphoblastic leukemia (T-ALL), chronic lymphocytic leukemia (CLL), hairy cell leukemia, chronic myelogenous leukemia (CML), non-Hodgkin lymphoma, diffuse large B-cell lymphoma (DLBCL), mantle cell lymphoma (MCL), and cutaneous T cell lymphoma (CTCL).

In some embodiments, the neoantigen therapeutic is administered as a combination therapy. Combination therapy with two or more therapeutic agents uses agents that work by different mechanisms of action, although this is not required. Combination therapy using agents with different mechanisms of action can result in additive or synergetic effects. Combination therapy can allow for a lower dose of each agent than is used in monotherapy, thereby reducing toxic side effects and/or increasing the therapeutic index of the agent(s). Combination therapy can decrease the likelihood that resistant cancer cells will develop. In some embodiments, combination therapy comprises a therapeutic agent that affects the immune response (e.g., enhances or activates the response) and a therapeutic agent that affects (e.g., inhibits or kills) the tumor/cancer cells.

In some instances, an immunogenic pharmaceutical composition can be administered with an additional agent. The choice of the additional agent can depend, at least in part, on the condition being treated. The additional agent can include, for example, a checkpoint inhibitor agent such as an anti-PD1, anti-CTLA4, anti-PD-L1, anti CD40, or anti-TIM3 agent (e.g., an anti-PD1, anti-CTLA4, anti-PD-L1, anti CD40, or anti-TIM3 antibody); or any agents having a therapeutic effect for a pathogen infection (e.g. viral infection), including, e.g., drugs used to treat inflammatory conditions such as an NSAID, e.g., ibuprofen, naproxen, acetaminophen, ketoprofen, or aspirin. For example, the checkpoint inhibitor can be a PD-1/PD-L1 antagonist selected from the group consisting of: nivolumab (ONO-4538/BMS-936558, MDX1 106, OPDIVO), pembrolizumab (MK-3475, KEYTRUDA), pidilizumab (CT-011), and MPDL3280A (ROCHE). As another example, formulations can additionally contain one or more supplements, such as vitamin C, E or other anti-oxidants.

The methods of the disclosure can be used to treat any type of cancer known in the art. Non-limiting examples of cancers to be treated by the methods of the present disclosure can include melanoma (e.g., metastatic malignant melanoma), renal cancer (e.g., clear cell carcinoma), prostate cancer (e.g., hormone refractory prostate adenocarcinoma), pancreatic adenocarcinoma, breast cancer, colon cancer, lung cancer (e.g., non-small cell lung cancer), esophageal cancer, squamous cell carcinoma of the head and neck, liver cancer, ovarian cancer, cervical cancer, thyroid cancer, glioblastoma, glioma, leukemia, lymphoma, and other neoplastic malignancies.

Additionally, the disease or condition provided herein includes refractory or recurrent malignancies whose growth may be inhibited using the methods of treatment of the present disclosure. In some embodiments, a cancer to be treated by the methods of treatment of the present disclosure is selected from the group consisting of carcinoma, squamous carcinoma, adenocarcinoma, sarcomata, endometrial cancer, breast cancer, ovarian cancer, cervical cancer, fallopian tube cancer, primary peritoneal cancer, colon cancer, colorectal cancer, squamous cell carcinoma of the anogenital region, melanoma, renal cell carcinoma, lung cancer, non-small cell lung cancer, squamous cell carcinoma of the lung, stomach cancer, bladder cancer, gall bladder cancer, liver cancer, thyroid cancer, laryngeal cancer, salivary gland cancer, esophageal cancer, head and neck cancer, glioblastoma, glioma, squamous cell carcinoma of the head and neck, prostate cancer, pancreatic cancer, mesothelioma, sarcoma, hematological cancer, leukemia, lymphoma, neuroma, and combinations thereof. In some embodiments, a cancer to be treated by the methods of the present disclosure include, for example, carcinoma, squamous carcinoma (for example, cervical canal, eyelid, tunica conjunctiva, vagina, lung, oral cavity, skin, urinary bladder, tongue, larynx, and gullet), and adenocarcinoma (for example, prostate, small intestine, endometrium, cervical canal, large intestine, lung, pancreas, gullet, rectum, uterus, stomach, mammary gland, and ovary). In some embodiments, a cancer to be treated by the methods of the present disclosure further include sarcomata (for example, myogenic sarcoma), leukosis, neuroma, melanoma, and lymphoma. In some embodiments, a cancer to be treated by the methods of the present disclosure is breast cancer. In some embodiments, a cancer to be treated by the methods of treatment of the present disclosure is triple negative breast cancer (TNBC). In some embodiments, a cancer to be treated by the methods of treatment of the present disclosure is ovarian cancer. In some embodiments, a cancer to be treated by the methods of treatment of the present disclosure is colorectal cancer.

In some embodiments, a patient or population of patients to be treated with a pharmaceutical composition of the present disclosure have a solid tumor. In some embodiments, a solid tumor is a melanoma, renal cell carcinoma, lung cancer, bladder cancer, breast cancer, cervical cancer, colon cancer, gall bladder cancer, laryngeal cancer, liver cancer, thyroid cancer, stomach cancer, salivary gland cancer, prostate cancer, pancreatic cancer, or Merkel cell carcinoma. In some embodiments, a patient or population of patients to be treated with a pharmaceutical composition of the present disclosure have a hematological cancer. In some embodiments, the patient has a hematological cancer such as Diffuse large B cell lymphoma ("DLBCL"), Hodgkin's lymphoma ("HL"), Non-Hodgkin's lymphoma ("NHL"), Follicular lymphoma ("FL"), acute myeloid leukemia ("AML"), or Multiple myeloma ("MM"). In some embodiments, a patient or population of patients to be treated having the cancer selected from the group consisting of ovarian cancer, lung cancer and melanoma.

Specific examples of cancers that can be prevented and/or treated in accordance with present disclosure include, but are not limited to, the following: renal cancer, kidney cancer, glioblastoma multiforme, metastatic breast cancer; breast carcinoma; breast sarcoma; neurofibroma; neurofibromatosis; pediatric tumors; neuroblastoma; malignant melanoma; carcinomas of the epidermis; leukemias such as but not limited to, acute leukemia, acute lymphocytic leukemia, acute myelocytic leukemias such as myeloblastic, promyelocytic, myelomonocytic, monocytic, erythroleukemia leukemias and myelodysplastic syndrome, chronic leukemias such as but not limited to, chronic myelocytic (granulocytic) leukemia, chronic lymphocytic leukemia, hairy cell leukemia; polycythemia vera; lymphomas such as but not limited to Hodgkin's disease, non-Hodgkin's disease; multiple myelomas such as but not limited to smoldering multiple myeloma, nonsecretory myeloma, osteosclerotic myeloma, plasma cell leukemia, solitary plasmacytoma and extramedullary plasmacytoma; Waldenstrom's macroglobulinemia; monoclonal gammopathy of undetermined significance; benign monoclonal gammopathy; heavy chain disease; bone cancer and connective tissue sarcomas such as but not limited to bone sarcoma, myeloma bone disease, multiple myeloma, cholesteatoma-induced bone osteosarcoma, Paget's disease of bone, osteosarcoma, chondrosarcoma, Ewing's sarcoma, malignant giant cell tumor, fibrosarcoma of bone, chordoma, periosteal sarcoma, soft-tissue sarcomas, angiosarcoma (hemangiosarcoma), fibrosarcoma, Kaposi's sarcoma, leiomyosarcoma, liposarcoma, lymphangio sarcoma, neurilemmoma, rhabdomyosarcoma, and synovial sarcoma; brain tumors such as but not limited to, glioma, astrocytoma, brain stem glioma, ependymoma, oligodendroglioma, nonglial tumor, acoustic neurinoma, craniopharyngioma, medulloblastoma, meningioma, pineocytoma, pineoblastoma, and primary brain lymphoma; breast cancer including but not limited to adenocarcinoma, lobular (small cell) carcinoma, intraductal carcinoma, medullary breast cancer, mucinous breast cancer, tubular breast cancer, papillary breast cancer, Paget's disease (including juvenile Paget's disease) and inflammatory breast cancer; adrenal cancer such as but not limited to pheochromocytom and adrenocortical carcinoma; thyroid cancer such as but not limited to papillary or follicular thyroid cancer, medullary thyroid cancer and anaplastic thyroid cancer; pancreatic cancer such as but not limited to, insulinoma, gastrinoma, glucagonoma, vipoma, somatostatin-secreting tumor, and carcinoid or islet cell tumor; pituitary cancers such as but limited to Cushing's disease, prolactin-secreting tumor, acromegaly, and diabetes insipidus; eye cancers such as but not limited to ocular melanoma such as iris melanoma, choroidal melanoma, and cilliary body melanoma, and retinoblastoma; vaginal cancers such as squamous cell carcinoma, adenocarcinoma, and melanoma; vulvar cancer such as squamous cell carcinoma, melanoma, adenocarcinoma, basal cell carcinoma, sarcoma, and Paget's disease; cervical cancers such as but not limited to, squamous cell carcinoma, and adenocarcinoma; uterine cancers such as but not limited to endometrial carcinoma and uterine sarcoma; ovarian cancers such as but not limited to, ovarian epithelial carcinoma, borderline tumor, germ cell tumor, and stromal tumor; cervical carcinoma; esophageal cancers such as but not limited to, squamous cancer, adenocarcinoma, adenoid cyctic carcinoma, mucoepidermoid carcinoma, adenosquamous carcinoma, sarcoma, melanoma, plasmacytoma, verrucous carcinoma, and oat cell (small cell) carcinoma; stomach cancers such as but not limited to, adenocarcinoma, fungating (polypoid), ulcerating, superficial spreading, diffusely spreading, malignant lymphoma, liposarcoma, fibrosarcoma, and carcinosarcoma; colon cancers; colorectal cancer, KRAS mutated colorectal cancer; colon carcinoma; rectal cancers; liver cancers such as but not limited to hepatocellular carcinoma and hepatoblastoma, gallbladder cancers such as adenocarcinoma; cholangiocarcinomas such as but not limited to pappillary, nodular, and diffuse; lung cancers such as KRAS-mutated non-small cell lung cancer, non-small cell lung cancer, squamous cell carcinoma (epidermoid carcinoma), adenocarcinoma, large-cell carcinoma and small-cell lung cancer; lung carcinoma; testicular cancers such as but not limited to germinal tumor, seminoma, anaplastic, classic (typical), spermatocytic, nonseminoma, embryonal carcinoma, teratoma carcinoma, choriocarcinoma (yolk-sac tumor), prostate cancers such as but not limited to, androgen-independent prostate cancer, androgen-dependent prostate cancer, adenocarcinoma, leiomyosarcoma, and rhabdomyosarcoma; penal cancers; oral cancers such as but not limited to squamous cell carcinoma; basal cancers; salivary gland cancers such as but not limited to adenocarcinoma, mucoepidermoid carcinoma, and adenoidcystic carcinoma; pharynx cancers such as but not limited to squamous cell cancer, and verrucous; skin cancers such as but not limited to, basal cell carcinoma, squamous cell carcinoma and melanoma, superficial spreading melanoma, nodular melanoma, lentigo malignant melanoma, acrallentiginous melanoma; kidney cancers such as but not limited to renal cell cancer, adenocarcinoma, hypernephroma, fibrosarcoma, transitional cell cancer (renal pelvis and/or uterer); renal carcinoma; Wilms' tumor; bladder cancers such as but not limited to transitional cell carcinoma, squamous cell cancer, adenocarcinoma, carcinosarcoma. In addition, cancers include myxosarcoma, osteogenic sarcoma, endotheliosarcoma, lymphangioendotheliosarcoma, mesothelioma, synovioma, hemangioblastoma, epithelial carcinoma, cystadenocarcinoma, bronchogenic carcinoma, sweat gland carcinoma, sebaceous gland carcinoma, papillary carcinoma and papillary adenocarcinomas.

Cancers include, but are not limited to, B cell cancer, e.g., multiple myeloma, Waldenstrom's macroglobulinemia, the heavy chain diseases, such as, for example, alpha chain disease, gamma chain disease, and mu chain disease, benign monoclonal gammopathy, and immunocytic amyloidosis, melanomas, breast cancer, lung cancer, bronchus cancer, colorectal cancer, prostate cancer (e.g., metastatic, hormone refractory prostate cancer), pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematological tissues, and the like. Other non-limiting examples of types of cancers applicable to the methods encompassed by the present disclosure include human sarcomas and carcinomas, e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, colorectal cancer, pancreatic cancer, breast cancer, ovarian cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, liver cancer, choriocarcinoma, seminoma, embryonal carcinoma, Wilms' tumor, cervical cancer, bone cancer, brain tumor, testicular cancer, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma; leukemias, e.g., acute lymphocytic leukemia and acute myelocytic leukemia (myeloblastic, promyelocytic, myelomonocytic, monocytic and erythroleukemia); chronic leukemia (chronic myelocytic (granulocytic) leukemia and chronic lymphocytic leukemia); and polycythemia vera, lymphoma (Hodgkin's disease and non-Hodgkin's disease), multiple myeloma, Waldenstrom's macroglobulinemia, and heavy chain disease. In some embodiments, the cancer whose phenotype is determined by the method of the present disclosure is an epithelial cancer such as, but not limited to, bladder cancer, breast cancer, cervical cancer, colon cancer, gynecologic cancers, renal cancer, laryngeal cancer, lung cancer, oral cancer, head and neck cancer, ovarian cancer, pancreatic cancer, prostate cancer, or skin cancer. In other embodiments, the cancer is breast cancer, prostate cancer, lung cancer, or colon cancer. In still other embodiments, the epithelial cancer is non-small-cell lung cancer, nonpapillary renal cell carcinoma, cervical carcinoma, ovarian carcinoma (e.g., serous ovarian carcinoma), or breast carcinoma. The epithelial cancers may be characterized in various other ways including, but not limited to, serous, endometrioid, mucinous, clear cell, brenner, or undifferentiated. In some embodiments, the present disclosure is used in the treatment, diagnosis, and/or prognosis of lymphoma or its subtypes, including, but not limited to, mantle cell lymphoma. Lymphoproliferative disorders are also considered to be proliferative diseases.

In some embodiments, the combination of an agent described herein and at least one additional therapeutic agent results in additive or synergistic results. In some embodiments, the combination therapy results in an increase in the therapeutic index of the agent. In some embodiments, the combination therapy results in an increase in the therapeutic index of the additional therapeutic agent(s). In some embodiments, the combination therapy results in a decrease in the toxicity and/or side effects of the agent. In some embodiments, the combination therapy results in a decrease in the toxicity and/or side effects of the additional therapeutic agent(s).

In certain embodiments, in addition to administering a neoantigen therapeutic described herein, the method or treatment further comprises administering at least one additional therapeutic agent. An additional therapeutic agent can be administered prior to, concurrently with, and/or subsequently to, administration of the agent. In some embodiments, the at least one additional therapeutic agent comprises 1, 2, 3, or more additional therapeutic agents.

Therapeutic agents that can be administered in combination with the neoantigen therapeutic described herein include chemotherapeutic agents. Thus, in some embodiments, the method or treatment involves the administration of an agent described herein in combination with a chemotherapeutic agent or in combination with a cocktail of chemotherapeutic agents. Treatment with an agent can occur prior to, concurrently with, or subsequent to administration of chemotherapies. Combined administration can include co-administration, either in a single pharmaceutical formulation or using separate formulations, or consecutive administration in either order but generally within a time period such that all active agents can exert their biological activities simultaneously. Preparation and dosing schedules for such chemotherapeutic agents can be used according to manufacturers' instructions or as determined empirically by the skilled practitioner. Preparation and dosing schedules for such chemotherapy are also described in The Chemotherapy Source Book, 4th Edition, 2008, M. C. Perry, Editor, Lippincott, Williams & Wilkins, Philadelphia, PA.

Useful classes of chemotherapeutic agents include, for example, anti-tubulin agents, auristatins, DNA minor groove binders, DNA replication inhibitors, alkylating agents (e.g., platinum complexes such as cisplatin, mono(platinum), bis (platinum) and tri-nuclear platinum complexes and carboplatin), anthracyclines, antibiotics, anti-folates, antimetabolites, chemotherapy sensitizers, duocarmycins, etoposides, fluorinated pyrimidines, ionophores, lexitropsins, nitrosoureas, platinols, purine antimetabolites, puromycins, radiation sensitizers, steroids, taxanes, topoisomerase inhibitors, *vinca* alkaloids, or the like. In certain embodiments, the second therapeutic agent is an alkylating agent, an antimetabolite, an antimitotic, a topoisomerase inhibitor, or an angiogenesis inhibitor.

Chemotherapeutic agents useful in the present disclosure include, but are not limited to, alkylating agents such as thiotepa and cyclosphosphamide (CYTOXAN); alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphaoramide and trimethylolomelamime; nitrogen mustards such as chlorambucil, chlornaphazine, cholphosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, caminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytosine arabinoside, dideoxyuridine, doxifluridine, enocitabine, floxuridine, 5-FU; androgens such as calusterone, dromostanolone propionate, epitiostanol, mepitiostane, testolactone; anti-adrenals such as aminoglutethimide, mitotane, trilostane; folic acid replenishers such as folinic acid; aceglatone; aldophosphamide glycoside; aminolevulinic acid; amsacrine; bestrabucil; bisantrene; edatraxate; defofamine; demecolcine; diaziquone; elformithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK; razoxane; sizofuran; spirogermanium; tenuazonic acid; triaziquone; 2,2', 2"-trichlorotriethylamine; urethan; vindesine; dacarbazine; mannomustine; mitobronitol; mitolactol; pipobroman; gacytosine; arabinoside (Ara-C); taxoids, e.g. paclitaxel (TAXOL) and docetaxel (TAXOTERE); chlorambucil; gemcitabine; 6-thioguanine; mercaptopurine; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; daunomycin; aminopterin; ibandronate; CPT11; topoisomerase inhibitor RFS 2000; difluoromethylornithine (DMFO); retinoic acid; esperamicins; capecitabine (XELODA); and pharmaceutically acceptable salts, acids or derivatives of any of the above. Chemotherapeutic agents also include anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone, and toremifene (FARESTON); and anti-androgens such as flutamide, nilutamide, bicalutamide, leuprolide, and goserelin; and pharmaceutically acceptable salts, acids or derivatives of any of the above. In certain embodiments, the additional therapeutic agent is cisplatin. In certain embodiments, the additional therapeutic agent is carboplatin.

In certain embodiments, the chemotherapeutic agent is a topoisomerase inhibitor. Topoisomerase inhibitors are chemotherapy agents that interfere with the action of a topoisomerase enzyme (e.g., topoisomerase I or II). Topoisomerase inhibitors include, but are not limited to, doxorubicin HCl, daunorubicin citrate, mitoxantrone HCl, actinomycin D, etoposide, topotecan HCl, teniposide (VM-26), and irinotecan, as well as pharmaceutically acceptable salts, acids, or derivatives of any of these. In some embodiments, the additional therapeutic agent is irinotecan.

In certain embodiments, the chemotherapeutic agent is an anti-metabolite. An anti-metabolite is a chemical with a structure that is similar to a metabolite required for normal biochemical reactions, yet different enough to interfere with one or more normal functions of cells, such as cell division. Anti-metabolites include, but are not limited to, gemcitabine, fluorouracil, capecitabine, methotrexate sodium, ralitrexed, pemetrexed, tegafur, cytosine arabinoside, thioguanine, 5-azacytidine, 6 mercaptopurine, azathioprine, 6-thioguanine, pentostatin, fludarabine phosphate, and cladribine, as well as pharmaceutically acceptable salts, acids, or derivatives of any of these. In certain embodiments, the additional therapeutic agent is gemcitabine.

In certain embodiments, the chemotherapeutic agent is an antimitotic agent, including, but not limited to, agents that bind tubulin. In some embodiments, the agent is a taxane. In certain embodiments, the agent is paclitaxel or docetaxel, or a pharmaceutically acceptable salt, acid, or derivative of paclitaxel or docetaxel. In certain embodiments, the agent is paclitaxel (TAXOL), docetaxel (TAXOTERE), albumin-bound paclitaxel (ABRAXANE), DHA-paclitaxel, or PG-paclitaxel. In certain alternative embodiments, the antimitotic agent comprises a *vinca* alkaloid, such as vincristine, vinblastine, vinorelbine, or vindesine, or pharmaceutically acceptable salts, acids, or derivatives thereof. In some embodiments, the antimitotic agent is an inhibitor of kinesin Eg5 or an inhibitor of a mitotic kinase such as Aurora A or Plk1. In certain embodiments, the additional therapeutic agent is paclitaxel. In some embodiments, the additional therapeutic agent is albumin-bound paclitaxel.

In some embodiments, an additional therapeutic agent comprises an agent such as a small molecule. For example, treatment can involve the combined administration of an agent of the present disclosure with a small molecule that acts as an inhibitor against tumor-associated antigens including, but not limited to, EGFR, HER2 (ErbB2), and/or VEGF. In some embodiments, an agent of the present disclosure is administered in combination with a protein kinase inhibitor selected from the group consisting of: gefitinib (IRESSA), erlotinib (TARCEVA), sunitinib (SUTENT), lapatanib, vandetanib (ZACTIMA), AEE788, CI-1033, cediranib (RECENTIN), sorafenib (NEXAVAR), and pazopanib (GW786034B). In some embodiments, an additional therapeutic agent comprises an mTOR inhibitor. In another embodiment, the additional therapeutic agent is chemotherapy or other inhibitors that reduce the number of Treg cells. In certain embodiments, the therapeutic agent is cyclophosphamide or an anti-CTLA4 antibody. In another embodiment, the additional therapeutic reduces the presence of myeloid-derived suppressor cells. In a further embodiment, the additional therapeutic is carbotaxol. In another embodiment, the additional therapeutic agent shifts cells to a T helper 1 response. In a further embodiment, the additional therapeutic agent is ibrutinib.

In some embodiments, an additional therapeutic agent comprises a biological molecule, such as an antibody. For example, treatment can involve the combined administration of an agent of the present disclosure with antibodies against tumor-associated antigens including, but not limited to, antibodies that bind EGFR, HER2/ErbB2, and/or VEGF. In certain embodiments, the additional therapeutic agent is an antibody specific for a cancer stem cell marker. In certain embodiments, the additional therapeutic agent is an antibody that is an angiogenesis inhibitor (e.g., an anti-VEGF or VEGF receptor antibody). In certain embodiments, the additional therapeutic agent is bevacizumab (AVASTIN), ramucirumab, trastuzumab (HERCEPTIN), pertuzumab (OMNITARG), panitumumab (VECTIBIX), nimotuzumab, zalutumumab, or cetuximab (ERBITUX).

The agents and compositions provided herein may be used alone or in combination with conventional therapeutic regimens such as surgery, irradiation, chemotherapy and/or bone marrow transplantation (autologous, syngeneic, allogeneic or unrelated). A set of tumor antigens can be useful, e.g., in a large fraction of cancer patients.

In some embodiments, at least one or more chemotherapeutic agents may be administered in addition to the composition comprising an immunogenic vaccine. In some embodiments, the one or more chemotherapeutic agents may belong to different classes of chemotherapeutic agents.

Examples of chemotherapy agents include, but are not limited to, alkylating agents such as nitrogen mustards (e.g. mechlorethamine (nitrogen mustard), chlorambucil, cyclophosphamide (Cytoxan®), ifosfamide, and melphalan); nitrosoureas (e.g. N-Nitroso-N-methylurea, streptozocin, carmustine (BCNU), lomustine, and semustine); alkyl sulfonates (e.g. busulfan); tetrazines (e.g. dacarbazine (DTIC), mitozolomide and temozolomide (Temodar®)); aziridines (e.g. thiotepa, mytomycin and diaziquone); and platinum drugs (e.g. cisplatin, carboplatin, and oxaliplatin); non-classical alkylating agents such as procarbazine and altretamine (hexamethylmelamine); anti-metabolite agents such as 5-fluorouracil (5-FU), 6-mercaptopurine (6-MP), capecitabine (Xeloda®), cladribine, clofarabine, cytarabine (Ara-C®), decitabine, floxuridine, fludarabine, nelarabine, gemcitabine (Gemzar®), hydroxyurea, methotrexate, pemetrexed (Alimta®), pentostatin, thioguanine, Vidaza; anti-microtubule agents such as *vinca* alkaloids (e.g. vincristine, vinblastine, vinorelbine, vindesine and vinflunine); taxanes (e.g. paclitaxel (Taxol®), docetaxel (Taxotere®)); podophyllotoxin (e.g. etoposide and teniposide); epothilones (e.g. ixabepilone (Ixempra®)); estramustine (Emcyt®); anti-tumor antibiotics such as anthracyclines (e.g. daunorubicin, doxorubicin (Adriamycin®, epirubicin, idarubicin); actinomycin-D; and bleomycin; topoisomerase I inhibitors such as topotecan and irinotecan (CPT-11); topoisomerase II inhibitors such as etoposide (VP-16), teniposide, mitoxantrone, novobiocin, merbarone and aclarubicin; corticosteroids such as prednisone, methylprednisolone (Solumedrol®), and dexamethasone (Decadron®); L-asparaginase; bortezomib (Velcade®); immunotherapeutic agents such as rituximab (Rituxan®), alemtuzumab (Campath®), thalidomide, lenalidomide (Revlimid®), BCG, interleukin-2, interferon-alfa and cancer vaccines such as Provenge®; hormone therapeutic agents such as fulvestrant (Faslodex®), tamoxifen, toremifene (Fareston®), anastrozole (Arimidex®), exemestan (Aromasin®), letrozole (Femara®), megestrol acetate (Megace®), estrogens, bicalutamide (Casodex®), flutamide (Eulexin®), nilutamide (Nilandron®), leuprolide (Lupron®) and goserelin (Zoladex®); differentiating agents such as retinoids, tretinoin (ATRA or Atralin®), bexarotene (Targretin®) and arsenic trioxide (Arsenox®); and targeted therapeutic agents such as imatinib (Gleevec®), gefitinib (Iressa®) and sunitinib (Sutent®). In some embodiments, the chemotherapy is a cocktail therapy. Examples of a cocktail therapy includes, but is not limited to, CHOP/R—CHOP (rituxan, cyclophosphamide, hydroxydoxorubicin, vincristine, and prednisone), EPOCH (etoposide, prednisone, vincristine, cyclophosphamide, hydroxydoxorubicin), Hyper-CVAD (cyclophosphamide, vincristine, hydroxydoxorubicin, dexamethasone), FOLFOX (fluorouracil (5-FU), leucovorin, oxaliplatin), ICE (ifosfamide, carboplatin, etoposide), DHAP (high-dose cytarabine [ara-C], dexamethasone, cisplatin), ESHAP (etoposide, methylprednisolone, cytarabine [ara-C], cisplatin) and CMF (cyclophosphamide, methotrexate, fluouracil).

In certain embodiments, an additional therapeutic agent comprises a second immunotherapeutic agent. In some embodiments, the additional immunotherapeutic agent includes, but is not limited to, a colony stimulating factor, an interleukin, an antibody that blocks immunosuppressive functions (e.g., an anti-CTLA-4 antibody, anti-CD28 antibody, anti-CD3 antibody, anti-PD-1 antibody, anti-PD-L1 antibody, anti-TIGIT antibody), an antibody that enhances immune cell functions (e.g., an anti-GITR antibody, an anti-OX-40 antibody, an anti-CD40 antibody, or an anti-4-1BB antibody), a toll-like receptor (e.g., TLR4, TLR7, TLR9), a soluble ligand (e.g., GITRL, GITRL-Fc, OX-40L, OX-40L-Fe, CD40L, CD40L-Fc, 4-1BB ligand, or 4-1BB ligand-Fc), or a member of the B7 family (e.g., CD80, CD86). In some embodiments, the additional immunotherapeutic agent targets CTLA-4, CD28, CD3, PD-1, PD-L1, TIGIT, GITR, OX-40, CD-40, or 4-1BB.

In some embodiments, the additional therapeutic agent is an immune checkpoint inhibitor. In some embodiments, the immune checkpoint inhibitor is an anti-PD-1 antibody, an anti-PD-L1 antibody, an anti-CTLA-4 antibody, an anti-CD28 antibody, an anti-TIGIT antibody, an anti-LAG3 antibody, an anti-TIM3 antibody, an anti-GITR antibody, an anti-4-1BB antibody, or an anti-OX-40 antibody. In some embodiments, the additional therapeutic agent is an anti-TIGIT antibody. In some embodiments, the additional therapeutic agent is an anti-PD-1 antibody selected from the group consisting of: nivolumab (OPDIVO), pembrolizumab (KEYTRUDA), pidilzumab, MEDI0680, REGN2810, BGB-A317, and PDR001. In some embodiments, the additional therapeutic agent is an anti-PD-L1 antibody selected from the group consisting of: BMS935559 (MDX-1105), atexolizumab (MPDL3280A), durvalumab (MEDI4736), and avelumab (MSB0010718C). In some embodiments, the additional therapeutic agent is an anti-CTLA-4 antibody selected from the group consisting of: ipilimumab (YERVOY) and tremelimumab. In some embodiments, the additional therapeutic agent is an anti-LAG-3 antibody selected from the group consisting of: BMS-986016 and LAG525. In some embodiments, the additional therapeutic agent is an anti-OX-40 antibody selected from the group consisting of:

MED16469, MED10562, and MOXR0916. In some embodiments, the additional therapeutic agent is an anti-4-1BB antibody selected from the group consisting of: PF-05082566.

In some embodiments, the neoantigen therapeutic can be administered in combination with a biologic molecule selected from the group consisting of: adrenomedullin (AM), angiopoietin (Ang), BMPs, BDNF, EGF, erythropoietin (EPO), FGF, GDNF, granulocyte colony stimulating factor (G-CSF), granulocyte-macrophage colony stimulating factor (GM-CSF), FLT-3L, macrophage colony stimulating factor (M-CSF), stem cell factor (SCF), GDF9, HGF, HDGF, IGF, migration-stimulating factor, myostatin (GDF-8), NGF, neurotrophins, PDGF, thrombopoietin, TGF-α, TGF-β, TNF-α, VEGF, P1GF, gamma-IFN, IL-1, IL-2, IL-3, IL-4, IL-5, IL-6, IL-7, IL-12, IL-15, and IL-18.

In some embodiments, treatment with a neoantigen therapeutic described herein can be accompanied by surgical removal of tumors, removal of cancer cells, or any other surgical therapy deemed necessary by a treating physician.

In certain embodiments, treatment involves the administration of a neoantigen therapeutic described herein in combination with radiation therapy. Treatment with an agent can occur prior to, concurrently with, or subsequent to administration of radiation therapy. Dosing schedules for such radiation therapy can be determined by the skilled medical practitioner.

Combined administration can include co-administration, either in a single pharmaceutical formulation or using separate formulations, or consecutive administration in either order but generally within a time period such that all active agents can exert their biological activities simultaneously.

It will be appreciated that the combination of a neoantigen therapeutic described herein and at least one additional therapeutic agent can be administered in any order or concurrently. In some embodiments, the agent will be administered to patients that have previously undergone treatment with a second therapeutic agent. In certain other embodiments, the neoantigen therapeutic and a second therapeutic agent will be administered substantially simultaneously or concurrently. For example, a subject can be given an agent while undergoing a course of treatment with a second therapeutic agent (e.g., chemotherapy). In certain embodiments, a neoantigen therapeutic will be administered within 1 year of the treatment with a second therapeutic agent. It will further be appreciated that the two (or more) agents or treatments can be administered to the subject within a matter of hours or minutes (i.e., substantially simultaneously).

For the treatment of a disease, the appropriate dosage of a neoantigen therapeutic described herein depends on the type of disease to be treated, the severity and course of the disease, the responsiveness of the disease, whether the agent is administered for therapeutic or preventative purposes, previous therapy, the patient's clinical history, and so on, all at the discretion of the treating physician. The neoantigen therapeutic can be administered one time or over a series of treatments lasting from several days to several months, or until a cure is effected or a diminution of the disease state is achieved (e.g., reduction in tumor size). Optimal dosing schedules can be calculated from measurements of drug accumulation in the body of the patient and will vary depending on the relative potency of an individual agent. The administering physician can determine optimum dosages, dosing methodologies, and repetition rates.

In some embodiments, a neoantigen therapeutic can be administered at an initial higher "loading" dose, followed by one or more lower doses. In some embodiments, the frequency of administration can also change. In some embodiments, a dosing regimen can comprise administering an initial dose, followed by additional doses (or "maintenance" doses) once a week, once every two weeks, once every three weeks, or once every month. For example, a dosing regimen can comprise administering an initial loading dose, followed by a weekly maintenance dose of, for example, one-half of the initial dose. Or a dosing regimen can comprise administering an initial loading dose, followed by maintenance doses of, for example one-half of the initial dose every other week. Or a dosing regimen can comprise administering three initial doses for 3 weeks, followed by maintenance doses of, for example, the same amount every other week.

As is known to those of skill in the art, administration of any therapeutic agent can lead to side effects and/or toxicities. In some cases, the side effects and/or toxicities are so severe as to preclude administration of the particular agent at a therapeutically effective dose. In some cases, therapy must be discontinued, and other agents can be tried. However, many agents in the same therapeutic class display similar side effects and/or toxicities, meaning that the patient either has to stop therapy, or if possible, suffer from the unpleasant side effects associated with the therapeutic agent.

In some embodiments, the dosing schedule can be limited to a specific number of administrations or "cycles". In some embodiments, the agent is administered for 3, 4, 5, 6, 7, 8, or more cycles. For example, the agent is administered every 2 weeks for 6 cycles, the agent is administered every 3 weeks for 6 cycles, the agent is administered every 2 weeks for 4 cycles, the agent is administered every 3 weeks for 4 cycles, etc. Dosing schedules can be decided upon and subsequently modified by those skilled in the art.

The present disclosure provides methods of administering to a subject a neoantigen therapeutic described herein comprising using an intermittent dosing strategy for administering one or more agents, which can reduce side effects and/or toxicities associated with administration of an agent, chemotherapeutic agent, etc. In some embodiments, a method for treating cancer in a human subject comprises administering to the subject a therapeutically effective dose of a neoantigen therapeutic in combination with a therapeutically effective dose of a chemotherapeutic agent, wherein one or both of the agents are administered according to an intermittent dosing strategy. In some embodiments, a method for treating cancer in a human subject comprises administering to the subject a therapeutically effective dose of a neoantigen therapeutic in combination with a therapeutically effective dose of a second immunotherapeutic agent, wherein one or both of the agents are administered according to an intermittent dosing strategy. In some embodiments, the intermittent dosing strategy comprises administering an initial dose of a neoantigen therapeutic to the subject, and administering subsequent doses of the agent about once every 2 weeks. In some embodiments, the intermittent dosing strategy comprises administering an initial dose of a neoantigen therapeutic to the subject, and administering subsequent doses of the agent about once every 3 weeks. In some embodiments, the intermittent dosing strategy comprises administering an initial dose of a neoantigen therapeutic to the subject, and administering subsequent doses of the agent about once every 4 weeks. In some embodiments, the agent is administered using an intermittent dosing strategy and the additional therapeutic agent is administered weekly.

The present disclosure provides compositions comprising the neoantigen therapeutic described herein. The present disclosure also provides pharmaceutical compositions comprising a neoantigen therapeutic described herein and a pharmaceutically acceptable vehicle. In some embodiments, the pharmaceutical compositions find use in immunotherapy. In some embodiments, the compositions find use in inhibiting tumor growth. In some embodiments, the pharmaceutical compositions find use in inhibiting tumor growth in a subject (e.g., a human patient). In some embodiments, the compositions find use in treating cancer. In some embodiments, the pharmaceutical compositions find use in treating cancer in a subject (e.g., a human patient).

Formulations are prepared for storage and use by combining a neoantigen therapeutic of the present disclosure with a pharmaceutically acceptable vehicle (e.g., a carrier or excipient). Those of skill in the art generally consider pharmaceutically acceptable carriers, excipients, and/or stabilizers to be inactive ingredients of a formulation or pharmaceutical composition. Exemplary formulations are listed in WO 2015/095811.

Suitable pharmaceutically acceptable vehicles include, but are not limited to, nontoxic buffers such as phosphate, citrate, and other organic acids; salts such as sodium chloride; antioxidants including ascorbic acid and methionine; preservatives such as octadecyldimethylbenzyl ammonium chloride, hexamethonium chloride, benzalkonium chloride, benzethonium chloride, phenol, butyl or benzyl alcohol, alkyl parabens, such as methyl or propyl paraben, catechol, resorcinol, cyclohexanol, 3-pentanol, and m-cresol; low molecular weight polypeptides (e.g., less than about 10 amino acid residues); proteins such as serum albumin, gelatin, or immunoglobulins; hydrophilic polymers such as polyvinylpyrrolidone; amino acids such as glycine, glutamine, asparagine, histidine, arginine, or lysine; carbohydrates such as monosaccharides, disaccharides, glucose, mannose, or dextrins; chelating agents such as EDTA; sugars such as sucrose, mannitol, trehalose or sorbitol; salt-forming counter-ions such as sodium; metal complexes such as Zn-protein complexes; and non-ionic surfactants such as TWEEN or polyethylene glycol (PEG). (Remington: The Science and Practice of Pharmacy, 22st Edition, 2012, Pharmaceutical Press, London.). In some embodiments, the vehicle is 5% dextrose in water.

The pharmaceutical compositions described herein can be administered in any number of ways for either local or systemic treatment. Administration can be topical by epidermal or transdermal patches, ointments, lotions, creams, gels, drops, suppositories, sprays, liquids and powders; pulmonary by inhalation or insufflation of powders or aerosols, including by nebulizer, intratracheal, and intranasal; oral; or parenteral including intravenous, intra-arterial, intratumoral, subcutaneous, intraperitoneal, intramuscular (e.g., injection or infusion), or intracranial (e.g., intrathecal or intraventricular).

The therapeutic formulation can be in unit dosage form. Such formulations include tablets, pills, capsules, powders, granules, solutions or suspensions in water or non-aqueous media, or suppositories.

The neoantigenic peptides described herein can also be entrapped in microcapsules. Such microcapsules are prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nanoparticles and nanocapsules) or in macroemulsions as described in Remington: The Science and Practice of Pharmacy, 22st Edition, 2012, Pharmaceutical Press, London.

In certain embodiments, pharmaceutical formulations include a neoantigen therapeutic described herein complexed with liposomes. Methods to produce liposomes are known to those of skill in the art. For example, some liposomes can be generated by reverse phase evaporation with a lipid composition comprising phosphatidylcholine, cholesterol, and PEG-derivatized phosphatidylethanolamine (PEG-PE). Liposomes can be extruded through filters of defined pore size to yield liposomes with the desired diameter.

In certain embodiments, sustained-release preparations comprising the neoantigenic peptides described herein can be produced. Suitable examples of sustained-release preparations include semi-permeable matrices of solid hydrophobic polymers containing an agent, where the matrices are in the form of shaped articles (e.g., films or microcapsules). Examples of sustained-release matrices include polyesters, hydrogels such as poly(2-hydroxyethyl-methacrylate) or poly(vinyl alcohol), polylactides, copolymers of L-glutamic acid and 7 ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), sucrose acetate isobutyrate, and poly-D-(−)-3-hydroxybutyric acid.

The present disclosure provides methods of treatment comprising an immunogenic vaccine. Methods of treatment for a disease (such as cancer or a viral infection) are provided. A method can comprise administering to a subject an effective amount of a composition comprising an immunogenic antigen. In some embodiments, the antigen comprises a viral antigen. In some embodiments, the antigen comprises a tumor antigen.

Non-limiting examples of vaccines that can be prepared include a peptide-based vaccine, a nucleic acid-based vaccine, an antibody based vaccine, a T cell based vaccine, and an antigen-presenting cell based vaccine.

Vaccine compositions can be formulated using one or more physiologically acceptable carriers including excipients and auxiliaries which facilitate processing of the active agents into preparations which can be used pharmaceutically. Proper formulation can be dependent upon the route of administration chosen. Any of the well-known techniques, carriers, and excipients can be used as suitable and as understood in the art.

In some cases, the vaccine composition is formulated as a peptide-based vaccine, a nucleic acid-based vaccine, an antibody based vaccine, or a cell based vaccine. For example, a vaccine composition can include naked cDNA in cationic lipid formulations; lipopeptides (e.g., Vitiello, A. et al., J. Clin. Invest. 95:341, 1995), naked cDNA or peptides, encapsulated e.g., in poly(DL-lactide-co-glycolide) ("PLG") microspheres (see, e.g., Eldridge, et al., Molec. Immunol. 28:287-294, 1991: Alonso et al, Vaccine 12:299-306, 1994; Jones et al, Vaccine 13:675-681, 1995); peptide composition contained in immune stimulating complexes (ISCOMS) (e.g., Takahashi et al, Nature 344:873-875, 1990; Hu et al, Clin. Exp. Immunol. 113:235-243, 1998); or multiple antigen peptide systems (MAPs) (see e.g., Tam, J. P., Proc. Natl Acad. Sci. U.S.A. 85:5409-5413, 1988; Tarn, J. P., J. Immunol. Methods 196:17-32, 1996). Sometimes, a vaccine is formulated as a peptide-based vaccine, or nucleic acid based vaccine in which the nucleic acid encodes the polypeptides. Sometimes, a vaccine is formulated as an antibody based vaccine. Sometimes, a vaccine is formulated as a cell based vaccine.

The amino acid sequence of an identified disease-specific immunogenic neoantigen peptide can be used develop a pharmaceutically acceptable composition. The source of antigen can be, but is not limited to, natural or synthetic proteins, including glycoproteins, peptides, and superantigens; antibody/antigen complexes; lipoproteins; RNA or a translation product thereof; and DNA or a polypeptide encoded by the DNA. The source of antigen may also comprise non-transformed, transformed, transfected, or transduced cells or cell lines. Cells may be transformed, transfected, or transduced using any of a variety of expression or retroviral vectors known to those of ordinary skill in the art that may be employed to express recombinant antigens. Expression may also be achieved in any appropriate host cell that has been transformed, transfected, or transduced with an expression or retroviral vector containing a DNA molecule encoding recombinant antigen(s). Any number of transfection, transformation, and transduction protocols known to those in the art may be used. Recombinant vaccinia vectors and cells infected with the vaccinia vector, may be used as a source of antigen.

A composition can comprise a synthetic disease-specific immunogenic neoantigen peptide. A composition can comprise two or more disease-specific immunogenic neoantigen peptides. A composition may comprise a precursor to a disease-specific immunogenic peptide (such as a protein, peptide, DNA and RNA). A precursor to a disease-specific immunogenic peptide can generate or be generated to the identified disease-specific immunogenic neoantigen peptide. In some embodiments, a therapeutic composition comprises a precursor of an immunogenic peptide. The precursor to a disease-specific immunogenic peptide can be a pro-drug. In some embodiments, the composition comprising a disease-specific immunogenic neoantigen peptide may further comprise an adjuvant. For example, the neoantigen peptide can be utilized as a vaccine. In some embodiments, an immunogenic vaccine may comprise a pharmaceutically acceptable immunogenic neoantigen peptide. In some embodiments, an immunogenic vaccine may comprise a pharmaceutically acceptable precursor to an immunogenic neoantigen peptide (such as a protein, peptide, DNA and RNA). In some embodiments, a method of treatment comprises administering to a subject an effective amount of an antibody specifically recognizing an immunogenic neoantigen peptide. In some embodiments, a method of treatment comprises administering to a subject an effective amount of a soluble TCR or TCR analog specifically recognizing an immunogenic neoantigen peptide.

The methods described herein are particularly useful in the personalized medicine context, where immunogenic neoantigen peptides are used to develop therapeutics (such as vaccines or therapeutic antibodies) for the same individual. Thus, a method of treating a disease in a subject can comprise identifying an immunogenic neoantigen peptide in a subject according to the methods described herein; and synthesizing the peptide (or a precursor thereof); and administering the peptide or an antibody specifically recognizing the peptide to the subject. In some embodiments, an expression pattern of an immunogenic neoantigen can serve as the essential basis for the generation of patient specific vaccines. In some embodiments, an expression pattern of an immunogenic neoantigen can serve as the essential basis for the generation of a vaccine for a group of patients with a particular disease. Thus, particular diseases, e.g., particular types of tumors, can be selectively treated in a patient group.

In some embodiments, the peptides described herein are structurally normal antigens that can be recognized by autologous anti-disease T cells in a large patient group. In some embodiments, an antigen-expression pattern of a group of diseased subjects whose disease expresses structurally normal neoantigens is determined.

In some embodiments, the peptides described herein comprises a first peptide comprising a first neoepitope of a protein and a second peptide comprising a second neoepitope of the same protein, wherein the first peptide is different from the second peptide, and wherein the first neoepitope comprises a mutation and the second neoepitope comprises the same mutation. In some embodiments, the peptides described herein comprises a first peptide comprising a first neoepitope of a first region of a protein and a second peptide comprising a second neoepitope of a second region of the same protein, wherein the first region comprises at least one amino acid of the second region, wherein the first peptide is different from the second peptide and wherein the first neoepitope comprises a first mutation and the second neoepitope comprises a second mutation. In some embodiments, the first mutation and the second mutation are the same. In some embodiments, the mutation is selected from the group consisting of a point mutation, a splice-site mutation, a frameshift mutation, a read-through mutation, a gene fusion mutation and any combination thereof.

There are a variety of ways in which to produce immunogenic neoantigens. Proteins or peptides may be made by any technique known to those of skill in the art, including the expression of proteins, polypeptides or peptides through standard molecular biological techniques, the isolation of proteins or peptides from natural sources, in vitro translation, or the chemical synthesis of proteins or peptides. In general, such disease specific neoantigens may be produced either in vitro or in vivo. Immunogenic neoantigens may be produced in vitro as peptides or polypeptides, which may then be formulated into a personalized vaccine or immunogenic composition and administered to a subject. In vitro production of immunogenic neoantigens can comprise peptide synthesis or expression of a peptide/polypeptide from a DNA or RNA molecule in any of a variety of bacterial, eukaryotic, or viral recombinant expression systems, followed by purification of the expressed peptide/polypeptide. Alternatively, immunogenic neoantigens can be produced in vivo by introducing molecules (e.g., DNA, RNA, and viral expression systems) that encode an immunogenic neoantigen into a subject, whereupon the encoded immunogenic neoantigens are expressed. In some embodiments, a polynucleotide encoding an immunogenic neoantigen peptide can be used to produce the neoantigen peptide in vitro.

In some embodiments, a polynucleotide comprises a sequence with at least 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a polynucleotide encoding an immunogenic neoantigen.

The polynucleotide may be, e.g., DNA, cDNA, PNA, CNA, RNA, single- and/or double-stranded, native or stabilized forms of polynucleotides, or combinations thereof. A nucleic acid encoding an immunogenic neoantigen peptide may or may not contain introns so long as it codes for the peptide. In some embodiments in vitro translation is used to produce the peptide.

Expression vectors comprising sequences encoding the neoantigen, as well as host cells containing the expression vectors, are also contemplated. Expression vectors suitable for use in the present disclosure can comprise at least one expression control element operationally linked to the nucleic acid sequence. The expression control elements are inserted in the vector to control and regulate the expression of the nucleic acid sequence. Examples of expression control elements are well known in the art and include, for example, the lac system, operator and promoter regions of phage lambda, yeast promoters and promoters derived from polyoma, adenovirus, retrovirus or SV40. Additional operational elements include, but are not limited to, leader sequences, termination codons, polyadenylation signals and any other sequences necessary or preferred for the appropriate transcription and subsequent translation of the nucleic acid sequence in the host system. It will be understood by one skilled in the art the correct combination of expression control elements will depend on the host system chosen. It will further be understood that the expression vector should contain additional elements necessary for the transfer and subsequent replication of the expression vector containing the nucleic acid sequence in the host system. Examples of such elements include, but are not limited to, origins of replication and selectable markers.

The neoantigen peptides may be provided in the form of RNA or cDNA molecules encoding the desired neoantigen peptides. One or more neoantigen peptides of the present disclosure may be encoded by a single expression vector. Generally, the DNA is inserted into an expression vector, such as a plasmid, in proper orientation and correct reading frame for expression, if necessary, the DNA may be linked to the appropriate transcriptional and translational regulatory control nucleotide sequences recognized by the desired host (e.g., bacteria), although such controls are generally available in the expression vector. The vector is then introduced into the host bacteria for cloning using standard techniques. Useful expression vectors for eukaryotic hosts, especially mammals or humans include, for example, vectors comprising expression control sequences from SV40, bovine papilloma virus, adenovirus and cytomegalovirus. Useful expression vectors for bacterial hosts include known bacterial plasmids, such as plasmids from $E.$ $coli$, including pCR 1, pBR322, pMB9 and their derivatives, wider host range plasmids, such as M13 and filamentous single-stranded DNA phages.

In embodiments, a DNA sequence encoding a polypeptide of interest can be constructed by chemical synthesis using an oligonucleotide synthesizer. Such oligonucleotides can be designed based on the amino acid sequence of the desired polypeptide and selecting those codons that are favored in the host cell in which the recombinant polypeptide of interest is produced. Standard methods can be applied to synthesize an isolated polynucleotide sequence encoding an isolated polypeptide of interest.

Suitable host cells for expression of a polypeptide include prokaryotes, yeast, insect or higher eukaryotic cells under the control of appropriate promoters. Prokaryotes include gram negative or gram positive organisms, for example $E.$ $coli$ or bacilli. Higher eukaryotic cells include established cell lines of mammalian origin. Cell-free translation systems can also be employed. Appropriate cloning and expression vectors for use with bacterial, fungal, yeast, and mammalian cellular hosts are well known in the art. Various mammalian or insect cell culture systems can be employed to express recombinant protein. Exemplary mammalian host cell lines include, but are not limited to COS-7, L cells, C127, 3T3, Chinese hamster ovary (CHO), 293, HeLa and BHK cell lines. Mammalian expression vectors can comprise nontranscribed elements such as an origin of replication, a suitable promoter and enhancer linked to the gene to be expressed, and other 5' or 3' flanking nontranscribed sequences, and 5' or 3' nontranslated sequences, such as necessary ribosome binding sites, a polyadenylation site, splice donor and acceptor sites, and transcriptional termination sequences.

The proteins produced by a transformed host can be purified according to any suitable method. Such standard methods include chromatography (e.g., ion exchange, affinity and sizing column chromatography, and the like), centrifugation, differential solubility, or by any other standard technique for protein purification. Affinity tags such as hexahistidine (SEQ ID NO: 2273), maltose binding domain, influenza coat sequence, glutathione-S-transferase, and the like can be attached to the protein to allow easy purification by passage over an appropriate affinity column. Isolated proteins can also be physically characterized using such techniques as proteolysis, nuclear magnetic resonance and x-ray crystallography.

A vaccine can comprise an entity that binds a polypeptide sequence described herein. The entity can be an antibody. Antibody-based vaccine can be formulated using any of the well-known techniques, carriers, and excipients as suitable and as understood in the art. In some embodiments, the peptides described herein can be used for making neoantigen specific therapeutics such as antibody therapeutics. For example, neoantigens can be used to raise and/or identify antibodies specifically recognizing the neoantigens. These antibodies can be used as therapeutics. The antibody can be a natural antibody, a chimeric antibody, a humanized antibody, or can be an antibody fragment. The antibody may recognize one or more of the polypeptides described herein. In some embodiments, the antibody can recognize a polypeptide that has a sequence with at most 40%, 50%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to a polypeptide described herein. In some embodiments, the antibody can recognize a polypeptide that has a sequence with at least 40%, 50%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% sequence identity to a polypeptide described herein. In some embodiments, the antibody can recognize a polypeptide sequence that is at least 30%, 40%, 50%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% of a length of a polypeptide described herein. In some embodiments, the antibody can recognize a polypeptide sequence that is at most 30%, 40%, 50%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% of a length of a polypeptide described herein.

The present disclosure also contemplates the use of nucleic acid molecules as vehicles for delivering neoantigen peptides/polypeptides to the subject in need thereof, in vivo, in the form of, e.g., DNA/RNA vaccines.

In some embodiments, the vaccine is a nucleic acid vaccine. In some embodiments, neoantigens can be administered to a subject by use of a plasmid. Plasmids may be introduced into animal tissues by a number of different methods, e.g., injection or aerosol instillation of naked DNA on mucosal surfaces, such as the nasal and lung mucosa. In some embodiments, physical delivery, such as with a "gene-gun" may be used. The exact choice of expression vectors can depend upon the peptide/polypeptides to be expressed, and is well within the skill of the ordinary artisan.

In some embodiments, the nucleic acid encodes an immunogenic peptide or peptide precursor. In some embodiments, the nucleic acid vaccine comprises sequences flanking the sequence coding the immunogenic peptide or peptide precursor. In some embodiments, the nucleic acid vaccine comprises more than one immunogenic epitope. In some embodiments, the nucleic acid vaccine is a DNA-based vaccine. In some embodiments, the nucleic acid vaccine is a RNA-based vaccine. In some embodiments, the RNA-based vaccine comprises mRNA. In some embodiments, the RNA-based vaccine comprises naked mRNA. In some embodiments, the RNA-based vaccine comprises modified mRNA (e.g., mRNA protected from degradation using protamine. mRNA containing modified 5' CAP structure or mRNA containing modified nucleotides). In some embodiments, the RNA-based vaccine comprises single-stranded mRNA.

The polynucleotide may be substantially pure, or contained in a suitable vector or delivery system. Suitable vectors and delivery systems include viral, such as systems based on adenovirus, vaccinia virus, retroviruses, herpes virus, adeno-associated virus or hybrids containing elements of more than one virus. Non-viral delivery systems include cationic lipids and cationic polymers (e.g., cationic liposomes).

One or more neoantigen peptides can be encoded and expressed in vivo using a viral based system. Viral vectors may be used as recombinant vectors in the present disclosure, wherein a portion of the viral genome is deleted to introduce new genes without destroying infectivity of the virus. The viral vector of the present disclosure is a non-pathogenic virus. In some embodiments the viral vector has a tropism for a specific cell type in the mammal. In another embodiment, the viral vector of the present disclosure is able to infect professional antigen presenting cells such as dendritic cells and macrophages. In yet another embodiment of the present disclosure, the viral vector is able to infect any cell in the mammal. The viral vector may also infect tumor cells. Viral vectors used in the present disclosure include but is not limited to Poxvirus such as vaccinia virus, avipox virus, fowlpox virus and a highly attenuated vaccinia virus (Ankara or MVA), retrovirus, adenovirus, baculovirus and the like.

A vaccine can be delivered via a variety of routes. Delivery routes can include oral (including buccal and sub-lingual), rectal, nasal, topical, transdermal patch, pulmonary, vaginal, suppository, or parenteral (including intramuscular, intra-arterial, intrathecal, intradermal, intraperitoneal, subcutaneous and intravenous) administration or in a form suitable for administration by aerosolization, inhalation or insufflation. General information on drug delivery systems can be found in Ansel et al., Pharmaceutical Dosage Forms and Drug Delivery Systems (Lippencott Williams & Wilkins, Baltimore Md. (1999). The vaccine described herein can be administered to muscle, or can be administered via intradermal or subcutaneous injections, or transdermally, such as by iontophoresis. Epidermal administration of the vaccine can be employed.

In some instances, the vaccine can also be formulated for administration via the nasal passages. Formulations suitable for nasal administration, wherein the carrier is a solid, can include a coarse powder having a particle size, for example, in the range of about 10 to about 500 microns which is administered in the manner in which snuff is taken, i.e., by rapid inhalation through the nasal passage from a container of the powder held close up to the nose. The formulation can be a nasal spray, nasal drops, or by aerosol administration by nebulizer. The formulation can include aqueous or oily solutions of the vaccine.

The vaccine can be a liquid preparation such as a suspension, syrup or elixir. The vaccine can also be a preparation for parenteral, subcutaneous, intradermal, intramuscular or intravenous administration (e.g., injectable administration), such as a sterile suspension or emulsion.

The vaccine can include material for a single immunization, or may include material for multiple immunizations (i.e. a 'multidose' kit). The inclusion of a preservative is preferred in multidose arrangements. As an alternative (or in addition) to including a preservative in multidose compositions, the compositions can be contained in a container having an aseptic adaptor for removal of material.

The vaccine can be administered in a dosage volume of about 0.5 mL, although a half dose (i.e. about 0.25 mL) can be administered to children. Sometimes the vaccine can be administered in a higher dose e.g. about 1 ml.

The vaccine can be administered as a 1, 2, 3, 4, 5, 6, 7, 8, 9, 10, or more dose-course regimen. Sometimes, the vaccine is administered as a 1, 2, 3, or 4 dose-course regimen. Sometimes the vaccine is administered as a 1 dose-course regimen. Sometimes the vaccine is administered as a 2 dose-course regimen.

The administration of the first dose and second dose can be separated by about 0 day, 1 day, 2 days, 5 days, 7 days, 14 days, 21 days, 30 days, 2 months, 4 months, 6 months, 9 months, 1 year, 1.5 years, 2 years, 3 years, 4 years, or more.

The vaccine described herein can be administered every 1, 2, 3, 4, 5, 6, 7, 8, 9, 10, or more years. Sometimes, the vaccine described herein is administered every 2, 3, 4, 5, 6, 7, or more years. Sometimes, the vaccine described herein is administered every 4, 5, 6, 7, or more years. Sometimes, the vaccine described herein is administered once.

The dosage examples are not limiting and are only used to exemplify particular dosing regiments for administering a vaccine described herein. The effective amount for use in humans can be determined from animal models. For example, a dose for humans can be formulated to achieve circulating, liver, topical and/or gastrointestinal concentrations that have been found to be effective in animals. Based on animal data, and other types of similar data, those skilled in the art can determine the effective amounts of a vaccine composition appropriate for humans.

The effective amount when referring to an agent or combination of agents will generally mean the dose ranges, modes of administration, formulations, etc., that have been recommended or approved by any of the various regulatory or advisory organizations in the medical or pharmaceutical arts (e.g., FDA, AMA) or by the manufacturer or supplier.

In some aspects, the vaccine and kit described herein can be stored at between 2° C. and 8° C. In some instances, the vaccine is not stored frozen. In some instances, the vaccine is stored in temperatures of such as at −20° C. or −80° C. In some instances, the vaccine is stored away from sunlight.

IX. Kits

The neoantigen therapeutic described herein can be provided in kit form together with instructions for administration. Typically the kit would include the desired neoantigen therapeutic in a container, in unit dosage form and instructions for administration. Additional therapeutics, for example, cytokines, lymphokines, checkpoint inhibitors, antibodies, can also be included in the kit. Other kit components that can also be desirable include, for example, a sterile syringe, booster dosages, and other desired excipients.

Kits and articles of manufacture are also provided herein for use with one or more methods described herein. The kits can contain one or more neoantigenic polypeptides comprising one or more neoepitopes. The kits can also contain nucleic acids that encode one or more of the peptides or proteins described herein, antibodies that recognize one or more of the peptides described herein, or APC-based cells activated with one or more of the peptides described herein. The kits can further contain adjuvants, reagents, and buffers necessary for the makeup and delivery of the vaccines.

The kits can also include a carrier, package, or container that is compartmentalized to receive one or more containers such as vials, tubes, and the like, each of the container(s) comprising one of the separate elements, such as the peptides and adjuvants, to be used in a method described herein. Suitable containers include, for example, bottles, vials, syringes, and test tubes. The containers can be formed from a variety of materials such as glass or plastic.

The articles of manufacture provided herein contain packaging materials. Examples of pharmaceutical packaging materials include, but are not limited to, blister packs, bottles, tubes, bags, containers, bottles, and any packaging material suitable for a selected formulation and intended mode of administration and treatment. A kit typically includes labels listing contents and/or instructions for use, and package inserts with instructions for use. A set of instructions will also typically be included.

The present disclosure will be described in greater detail by way of specific examples. The following examples are offered for illustrative purposes, and are not intended to limit the present disclosure in any manner. Those of skill in the art will readily recognize a variety of non-critical parameters that can be changed or modified to yield alternative embodiments according to the present disclosure. All patents, patent applications, and printed publications listed herein are incorporated herein by reference in their entirety.

EXAMPLES

These examples are provided for illustrative purposes only and not to limit the scope of the claims provided herein.

Example 1—Induction of CD4+ and CD8+ T Cell Responses

In vitro T cell inductions are used to expand neo-antigen specific T cells. Mature professional APCs are prepared for these assays in the following way. Monocytes are enriched from healthy human donor PBMCs using a bead-based kit (Miltenyi). Enriched cells are plated in GM-CSF and IL-4 to induce immature DCs. Enriched cells may also be plated using FLT-3L and IL-4 to induce immature DCs. After 5 days, immature DCs are incubated at 37° C. with pools of peptides for 1 hour before addition of a cytokine maturation cocktail (GM-CSF, IL-1β, IL-4, IL-6, TNFα, PGE1β). The maturation cocktail may in some cases include FLT-3L, IL-1β, IL-4, IL-6, TNFα, PGE1β. The pools of peptides can include multiple mutations, with both shortmers and longmers to expand CD8+ and CD4+ T cells, respectively. Long peptides were also used to demonstrate the possibility to stimulate CD8+ cells in this setting, also shown in FIG. 3C. Cells are incubated at 37° C. to mature DCs.

After maturation of DCs, PBMCs (either bulk or enriched for T cells) are added to mature dendritic cells with proliferation cytokines. Cultures are monitored for peptide-specific T cells using a combination of functional assays and/or tetramer staining. Parallel immunogenicity assays with the modified and parent peptides allowed for comparisons of the relative efficiency with which the peptides expanded peptide-specific T cells.

Example 2—Tetramer Staining Assay

MHC tetramers are purchased or manufactured on-site, and are used to measure peptide-specific T cell expansion in the immunogenicity assays. For the assessment, tetramer is added to $1\times10^5$ cells in PBS containing 1% FCS and 0.1% sodium azide (FACS buffer) according to manufacturer's instructions. Cells are incubated in the dark for 20 minutes at room temperature. Antibodies specific for T cell markers, such as CD8, are then added to a final concentration suggested by the manufacturer, and the cells are incubated in the dark at 4° C. for 20 minutes. Cells are washed with cold FACS buffer and resuspended in buffer containing 1% formaldehyde. Cells are acquired on a FACS Calibur (Becton Dickinson) instrument, and are analyzed by use of Cellquest software (Becton Dickinson). For analysis of tetramer positive cells, the lymphocyte gate is taken from the forward and side-scatter plots. Data are reported as the percentage of cells that were $CD8^+/tetramer^+$.

Example 3—Intracellular Cytokine Staining Assay

In the absence of well-established tetramer staining to identify antigen-specific T cell populations, antigen-specificity can be estimated using assessment of cytokine production using well-established flow cytometry assays. Briefly, T cells are stimulated with the peptide of interest and compared to a control. After stimulation, production of cytokines by $CD4^+$ T cells (e.g., IFNγ and TNFα) are assessed by intracellular staining. These cytokines, especially IFNγ, can be used to identify stimulated cells. FACS analysis of antigen-specific induction of IFNγ and TNFα levels of $CD4^+$ cells from a healthy donor stimulated with APCs loaded with or without a mutant RAS peptide was performed.

Example 4—ELISPOT Assay

Peptide-specific T cells are functionally enumerated using the ELISPOT assay (BD Biosciences), which measures the release of IFNγ from T cells on a single cell basis. Target cells (T2 or HLA-A0201 transfected C1Rs) were pulsed with 10 μM peptide for 1 hour at 37° C., and washed three times. $1\times10^5$ peptide-pulsed targets are co-cultured in the ELISPOT plate wells with varying concentrations of T cells ($5\times10^2$ to $2\times10^3$) taken from the immunogenicity culture. Plates are developed according to the manufacturer's protocol, and analyzed on an ELISPOT reader (Cellular Technology Ltd.) with accompanying software. Spots corresponding to the number of IFNγ-producing T cells are reported as the absolute number of spots per number of T cells plated. T cells expanded on modified peptides are tested not only for their ability to recognize targets pulsed with the modified peptide, but also for their ability to recognize targets pulsed with the parent peptide. The IFNγ levels of samples mock transduced or transduced with a lentiviral expression vector encoding a mutant RAS peptide were determined.

Example 5—CD107 Staining Assay

CD107a and b are expressed on the cell surface of CD8+ T cells following activation with cognate peptide. The lytic granules of T cells have a lipid bilayer that contains lysosomal-associated membrane glycoproteins ("LAMPs"), which include the molecules CD107a and b. When cytotoxic T cells are activated through the T cell receptor, the membranes of these lytic granules mobilize and fuse with the plasma membrane of the T cell. The granule contents are released, and this leads to the death of the target cell. As the granule membrane fuses with the plasma membrane, C107a and b are exposed on the cell surface, and therefore are markers of degranulation. Because degranulation as measured by CD107a and b staining is reported on a single cell basis, the assay is used to functionally enumerate peptide-specific T cells. To perform the assay, peptide is added to HLA-A02:01-transfected cells C1R to a final concentration of 20 µM, the cells were incubated for 1 hour at 37° C., and washed three times. $1 \times 10^5$ of the peptide-pulsed C1R cells were aliquoted into tubes, and antibodies specific for CD107a and b are added to a final concentration suggested by the manufacturer (Becton Dickinson). Antibodies are added prior to the addition of T cells in order to "capture" the CD107 molecules as they transiently appear on the surface during the course of the assay. $1 \times 10^5$ T cells from the immunogenicity culture are added next, and the samples were incubated for 4 hours at 37° C. The T cells are further stained for additional cell surface molecules such as CD8 and acquired on a FACS Calibur instrument (Becton Dickinson). Data is analyzed using the accompanying Cellquest software, and results are reported as the percentage of $CD8^+/CD107a$ and $b^+$ cells.

Example 6—Cytotoxicity Assays

Cytotoxic activity is measured using a chromium release assay. Target T2 cells are labeled for 1 hour at 37° C. with $Na^{51}Cr$ and washed $5 \times 10^3$ target T2 cells were then added to varying numbers of T cells from the immunogenicity culture. Chromium release is measured in supernatant harvested after 4 hours of incubation at 37° C. The percentage of specific lysis is calculated as: Experimental release-spontaneous release/Total release-spontaneous release×100.

Cytotoxicity activity is measured with the detection of cleaved Caspase 3 in target cells by Flow cytometry. Target cancer cells are engineered to express the mutant peptide along with the proper MHC-I allele. Mock-transduced target cells (i.e. not expressing the mutant peptide) are used as a negative control. The cells are labeled with CFSE to distinguish them from the stimulated PBMCs used as effector cells. The target and effector cells are co-cultured for 6 hours before being harvested. Intracellular staining is performed to detect the cleaved form of Caspase 3 in the CFSE-positive target cancer cells. The percentage of specific lysis is calculated as: Experimental cleavage of Caspase 3/spontaneous cleavage of Caspase 3 (measured in the absence of mutant peptide expression)×100.

In some examples, cytotoxicity activity is assessed by co-culturing T cells expressing a TCR specific to a mutant RAS peptide on a specific HLA, with mutant RAS peptide-transduced target cancer cells expressing the corresponding HLA, and by determining the relative growth of the target cells, along with measuring the apoptotic marker Annexin V in the target cancer cells specifically. Target cancer cells are engineered to express the mutant peptide along with the proper MHC-I allele. Mock-transduced target cells (i.e. not expressing the mutant peptide) are used as a negative control. The cells are also transduced to stably express GFP allowing the tracking of target cell growth. PBMCs from healthy donors, used as effector cells, are transduced to express a TCR specific to a mutant RAS peptide. Mock-transduced cells are used as a negative control. The target cells are cocultured with different amount of effector cells for 72 h in media containing Annexin V-detection reagent. The GFP signal and Annexin-V signal are measured over time with an IncuCyte S3 apparatus. Annexin V signal originating from effector cells is filtered out by size exclusion. Target cell growth and death is expressed as GFP and Annexin-V area ($mm^2$) over time, respectively.

Example 7—Enhanced CD8+ T Cell Responses In Vivo Using Longmers and Shortmers Sequentially Vaccination with longmer peptides can induce both $CD4^+$ and $CD8^+$ T cell responses, depending on the processing and presentation of the peptides. Vaccination with minimal shortmer epitopes focuses on generating $CD8^+$ T cell responses, but does not require peptide processing before antigen presentation. As such, any cell can present the epitope readily, not just professional antigen-presenting cells (APCs). This may lead to tolerance of T cells that come in contact with healthy cells presenting antigens as part of peripheral tolerance. To circumvent this, initial immunization with longmers allows priming of $CD8^+$ T cells only by APCs that can process and present the peptides. Subsequent immunizations boosts the initial $CD8^+$ T cell responses.

In Vivo Immunogenicity Assays

Nineteen 8-12 week old female C57BL/6 mice (Taconic Biosciences) were randomly and prospectively assigned to treatment groups on arrival. Animals were acclimated for three (3) days prior to study commencement. Animals were maintained on LabDiet™ 5053 sterile rodent chow and sterile water provided ad libitum. Animals in Group 1 served as vaccination adjuvant-only controls and were administered polyinosinic:polycytidylic acid (polyI:C) alone at 100 µg in a volume of 0.1 mL administered via subcutaneous injection (s.c.) on day 0, 7, and 14. Animals in Group 2 were administered 50 µg each of six longmer peptides (described below) along with polyL:C at 100 µg s.c. in a volume of 0.1 mL on day 0, 7 and 14. Animals in Group 3 were administered 50 µg each of six longmer peptides (described below) along with polyL:C at 100 µg s.c. in a volume of 0.1 mL on day 0 and molar-matched equivalents of corresponding shortmer peptides (described below) along with polyL:C at 100 µg s.c. in a volume of 0.1 mL on day 7 and 14. Animals were weighed and monitored for general health daily. Animals were euthanized by CO2 overdose at study completion Day 21, if an animal lost >30% of its body weight compared to weight at Day 0; or if an animal was found moribund. At sacrifice, spleens were harvested and processed into single-cell suspensions using standard protocols. Briefly, spleens were mechanical degraded through a 70 µM filter, pelleted, and lysed with ACK lysis buffer (Sigma) before resuspension in cell culture media.

Peptides

Six previously identified murine neoantigens were used based on their demonstrated ability to induce $CD8^+$ T cell responses. For each neoantigen, shortmers (8-11 amino acids) corresponding to the minimal epitope have been defined. Longmers corresponding to 20-27 amino acids surrounding the mutation were used.

ELISPOT

ELISPOT analysis (Mouse IFNγ ELISPOT Reasy-SET-Go; EBioscience) was performed according to the kit protocol. Briefly, one day prior to day of analysis, 96-well filter plates (0.45 µm pore size hydrophobic PVDF membrane; EMD Millipore) were activated (35% EtOH), washed (PBS) and coated with capture antibody (1:250; 4° C. O/N). On the day of analysis, wells were washed and blocked (media; 2 hours at 37° C.). Approximately 2×10⁵ cells in 100 µL was added to the wells along with 100 µL of 10 mM test peptide pool (shortmers), or PMA/ionomycin positive control antigen, or vehicle. Cells incubated with antigen overnight (16-18 hours) at 37° C. The next day, the cell suspension was discarded, and wells were washed once with PBS, and twice with deionized water. For all wash steps in the remainder of the assay, wells were allowed to soak for 3 minutes at each wash step. Wells were then washed three times with wash buffer (PBS+0.05% Tween-20), and detection antibody (1:250) was added to all wells. Plates were incubated for two hours at room temperature. The detection antibody solution was discarded, and wells were washed three times with wash buffer. Avidin-HRP (1:250) was added to all wells, and plates were incubated for one hour at room temperature. Conjugate solution was discarded, and wells washed three times with wash buffer, then once with PBS. Substrate (3-amino-9-ethyl-carbazole, 0.1 M Acetate buffer, $H_2O_2$) was added to all wells, and spot development monitored (approximately 10 minutes). Substrate reaction was stopped by washing wells with water, and plates were allowed to air-dry overnight. The plates were analyzed on an ELISPOT reader (Cellular Technology Ltd.) with accompanying software. Spots corresponding to the number of IFNγ-producing T cells are reported as the absolute number of spots per number of T cells plated.

Example 8—Detection of Mutant RAS Peptides by Mass Spectrometry 293T cells were transduced with a lentiviral vector encoding various regions of a mutant RAS peptide. 43 million of the transduced cells expressing peptides encoded by the a mutant RAS peptide were cultured and peptides were eluted from HLA-peptide complexes using an acid wash. Eluted peptides were then analyzed by MS/MS. For 293T cells expressing an HLA-A11:01 protein, the peptide

Figure 2A:
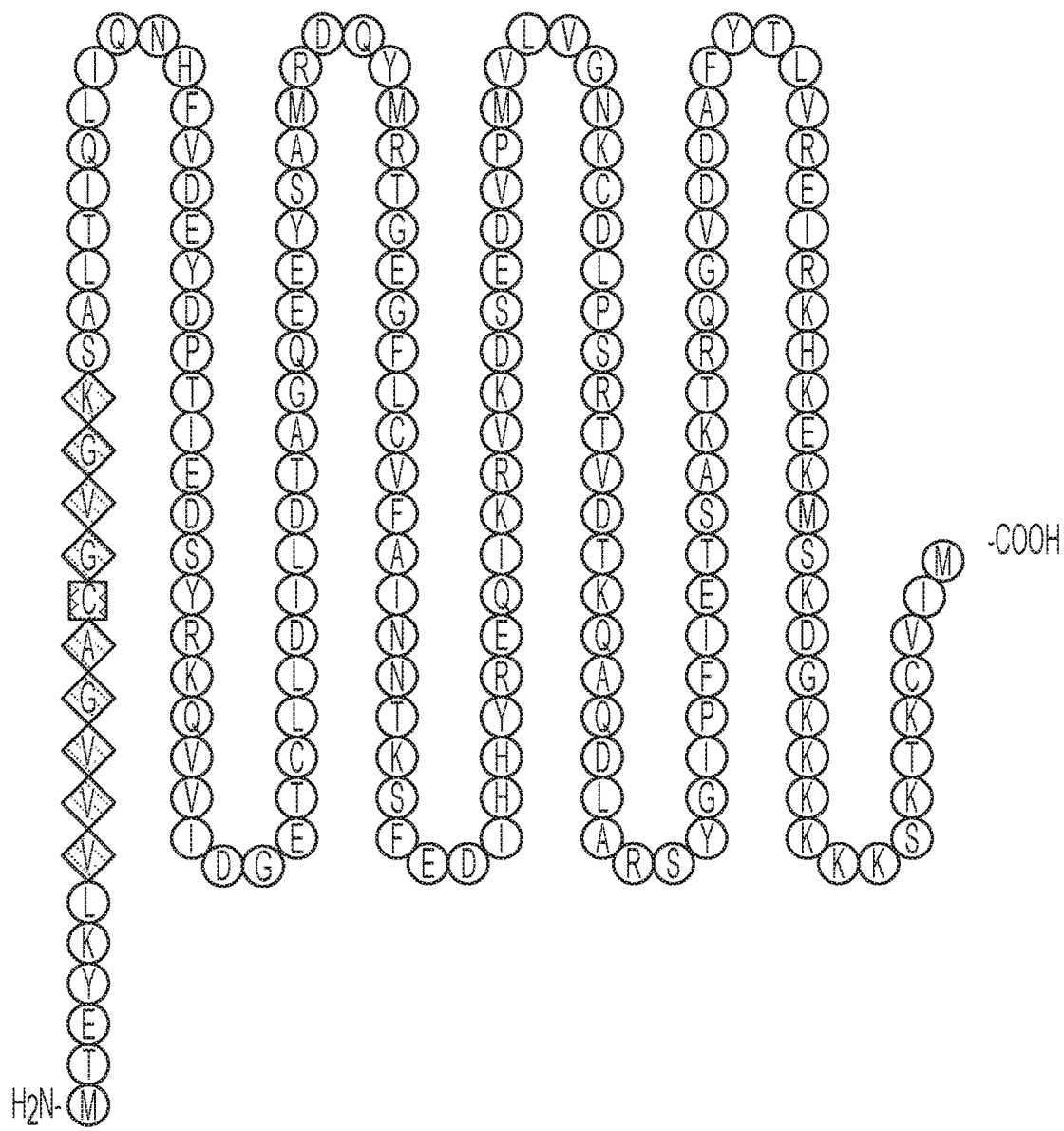
Figure 2A:
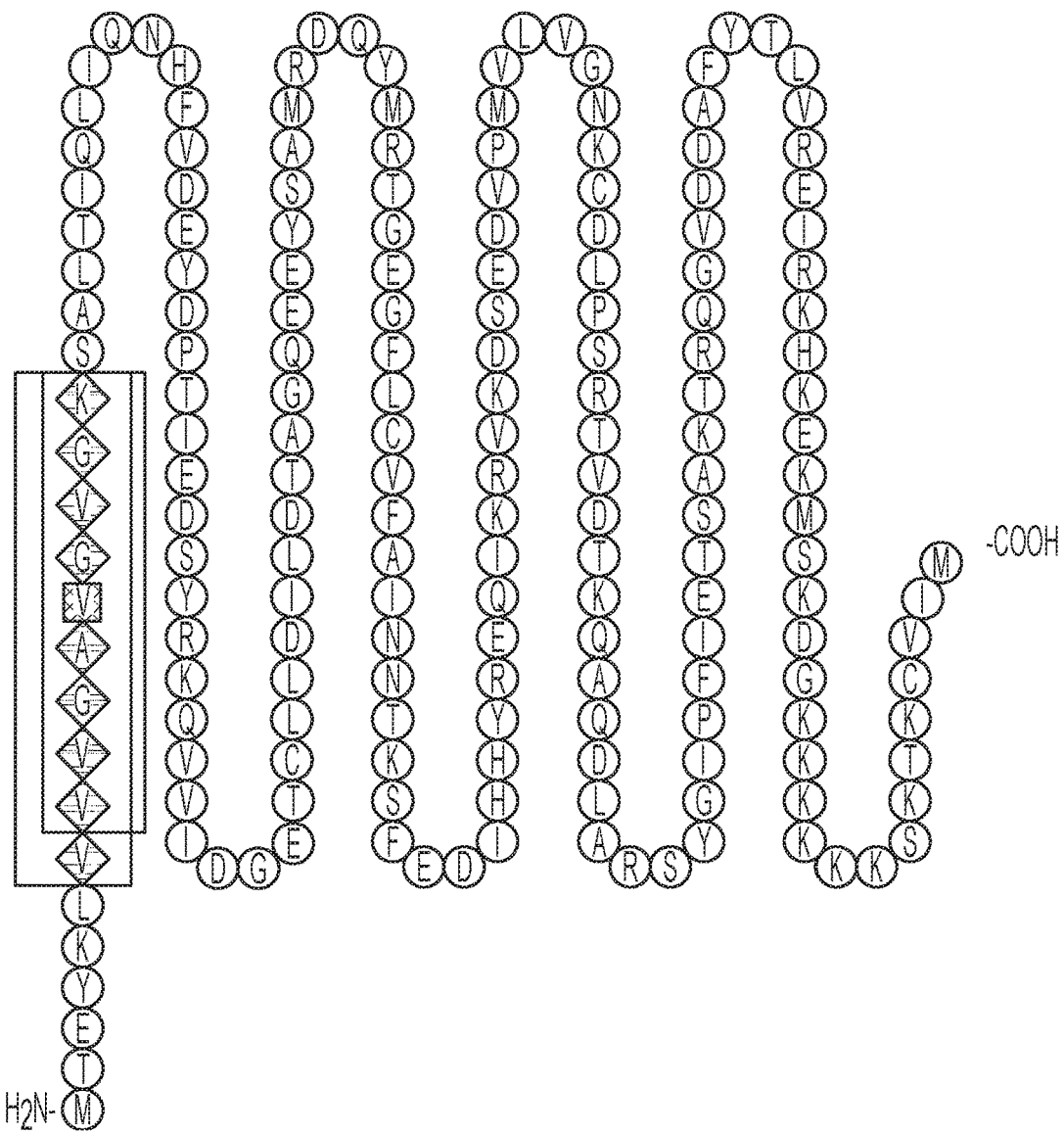

VVVGACGVGK, (SEQ ID NO: 2274)

was detected by mass spectrometry (FIG. 2). For 293T cells expressing an HLA-A11:01 protein, the peptides

VVVGAVGVGK (SEQ ID NO: 2275)

and

VVGAVGVGK, (SEQ ID NO: 2276)

was detected by mass spectrometry (FIG. 2).

Example 9—Mutant KRAS Peptides Produce Strong Epitopes on Multiple Alleles

Example 10—Multiple Neoepitopes Elicit CD8+ T Cell Responses

Figure 3A:
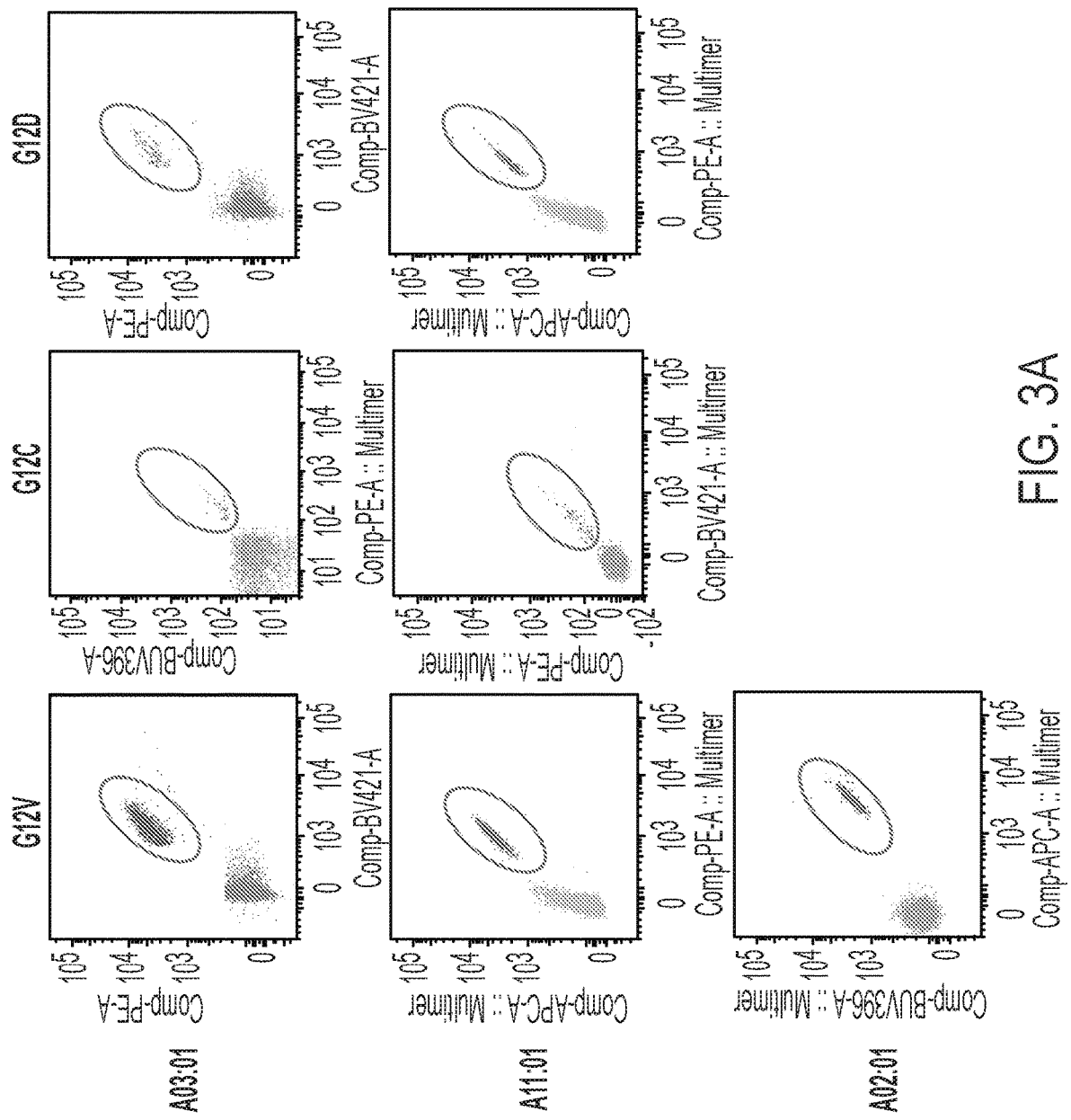
FIGS. 3A and 3B depict illustrative multimer plots of RAS-mutant specific CD8+ T cell responses.
Figure 3B:
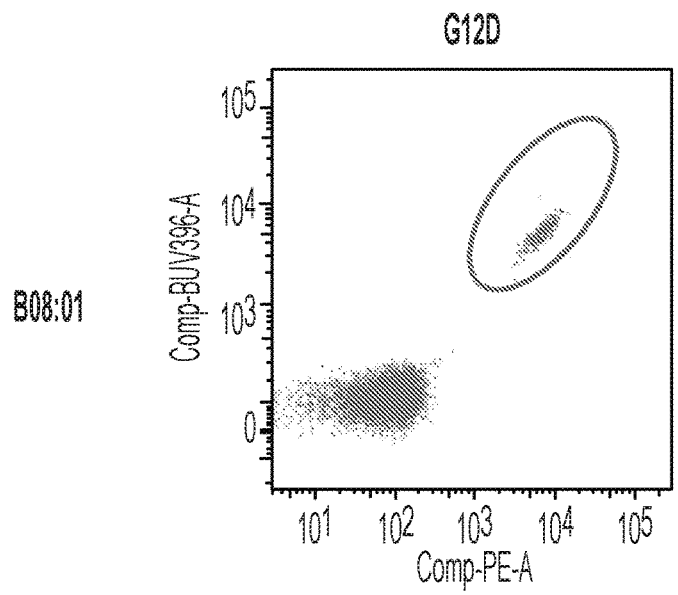
Figure 3C:
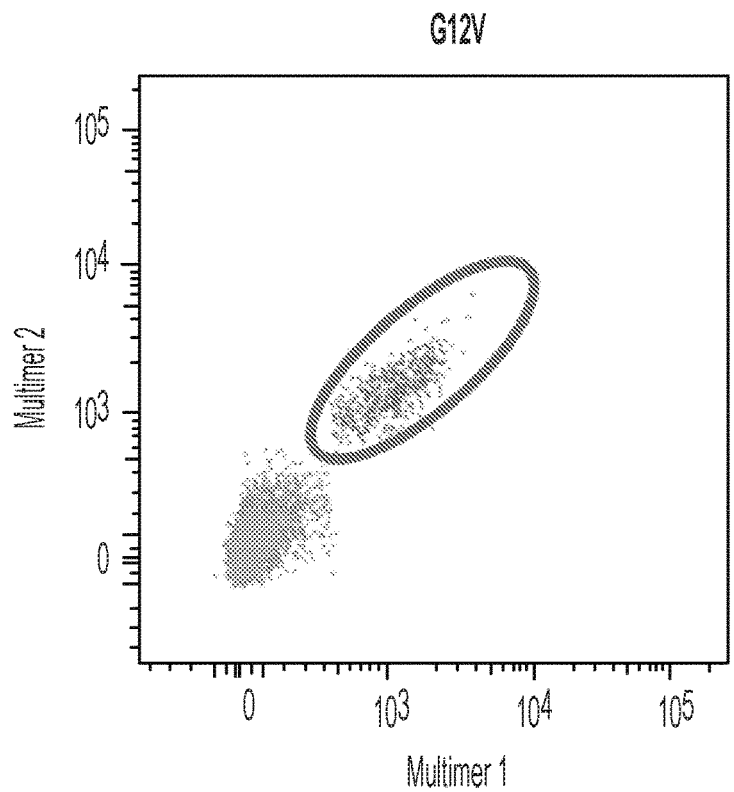
FIG. 3C depicts example results showing antigen specific CD8+ T cell responses to a long peptide containing the minimal epitope for KRAS G12V on HLA-A11:01. The sequences of the long peptide used to stimulate the response is indicated, as well as the sequence of the minimal epitope used for the multimer staining.

PBMC samples from a human donor were used to perform antigen specific T cell induction. CD8⁺ T cell inductions were analyzed after manufacturing T cells. Cell samples can be taken out at different time points for analysis. pMHC multimers were used to monitor the fraction of antigen specific CD8⁺ T cells in the induction cultures. FIGS. 3A-C depict exemplary results showing the fraction of antigen specific CD8⁺ T cells induced with a RAS G12V, a RAS G12 C and a RAS G12D mutant peptide. Long peptides were also used to demonstrate the possibility to stimulate CD8+ cells, as shown in FIG. 3C.

| Gene | HLA Allele | SEQ ID NO: | Peptide Sequence | Peptide Length | Measured Affinity (nM) | Measured stability (hr) |
|---|---|---|---|---|---|---|
| KRAS, G12C | A02.01 | 2277 | LVVVGACGV | 9 | 667.1 | 0.6 |
| KRAS, G12C | A02.01 | 2278 | KLVVVGACGV | 10 | 70.3 | 1.0 |
| KRAS, G12D | A02.01 | 2279 | LVVVGADGV | 9 | 977.4 | 0.0 |
| KRAS, G12D | A02.01 | 2280 | KLVVVGADGV | 10 | 137.7 | 0.9 |
| KRAS, G12V | A02.01 | 2281 | LVVVGAVGV | 9 | 682.5 | 0.6 |
| KRAS, G12V | A02.01 | 2282 | KLVVVGAVGV | 10 | 57.6 | 0.9 |
| KRAS, G12C | A03.01 | 2283 | VVGACGVGK | 9 | 4.1 | 5.0 |
| KRAS, G12C | A03.01 | 2284 | VVVGACGVGK | 10 | 1.6 | 2.5 |
| KRAS, G12D | A03.01 | 2285 | VVGADGVGK | 9 | 518.7 | NB |
| KRAS, G12D | A03.01 | 2286 | VVVGADGVGK | 10 | 314.9 | 2.3 |
| KRAS, G12V | A03.01 | 2287 | VVGAVGVGK | 9 | 1.9 | 1.2 |
| KRAS, G12V | A03.01 | 2288 | VVVGAVGVGK | 10 | 44.2 | 6.7 |
| KRAS, G12C | A11.01 | 2289 | VVGACGVGK | 9 | 43.2 | 10.0 |

| Gene | HLA Allele | SEQ ID NO: | Peptide Sequence | Peptide Length | Measured Affinity (nM) | Measured stability (hr) |
|---|---|---|---|---|---|---|
| KRAS, G12C | A11.01 | 2290 | VVVGACGVGK | 10 | 69.3 | 15.7 |
| KRAS, G12D | A11.01 | 2291 | VVGADGVGK | 9 | 203.9 | 3.4 |
| KRAS, G12D | A11.01 | 2292 | VVVGADGVGK | 10 | 33.1 | 13.0 |
| KRAS, G12V | A11.01 | 2293 | VVGAVGVGK | 9 | 7.7 | 16.9 |
| KRAS, G12V | A11.01 | 2294 | VVVGAVGVGK | 10 | 26.1 | 24.3 |

Example 11—Cytotoxicity Assay of Induced T Cells

Figure 4B:
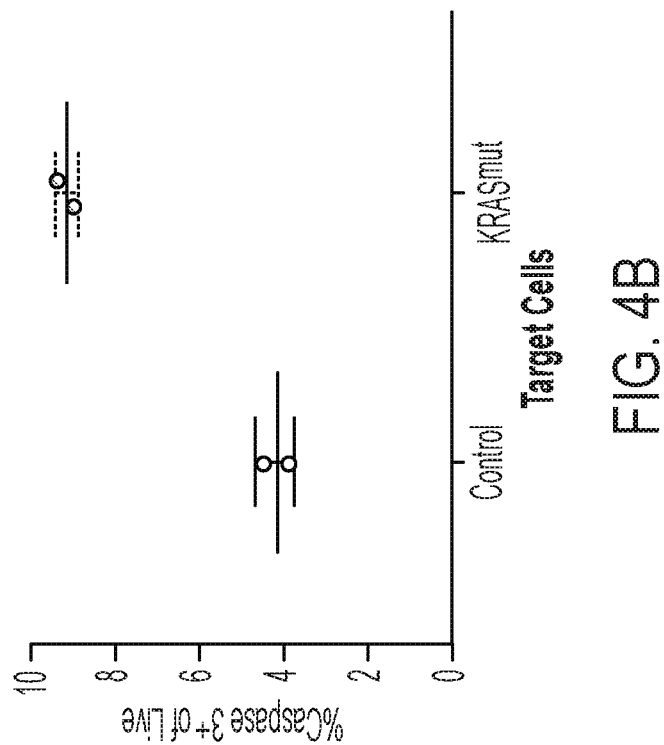
FIG. 4B is a graph showing upregulation of active caspase 3 on target cells. The percent live caspase-A positive target cells of samples mock transduced or transduced with a lentiviral expression vector encoding a mutant RAS peptide are shown.
Figure 4A:
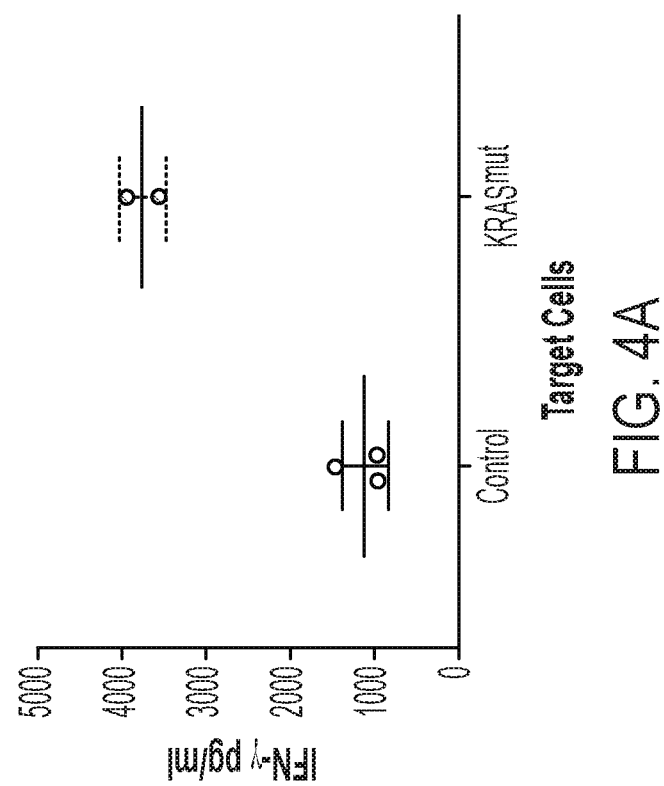
FIG. 4A is a graph showing antigen-specific induction of IFNγ. The IFNγ levels of samples mock transduced or transduced with a lentiviral expression vector encoding a mutant RAS peptide are shown.
Figure 5A:
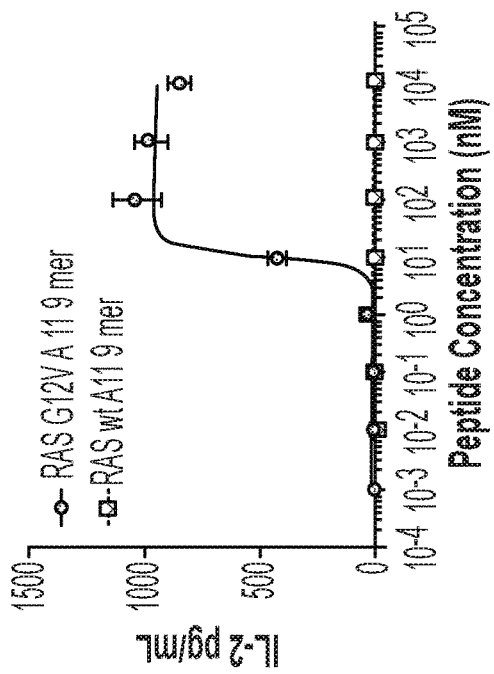
FIG. 5A is a graph showing antigen-specific induction of IL-2 by co-culturing T cells expressing a TCR specific to a mutant RAS peptide with 9mer or 11mer mutant RAS peptide-transduced target cells. The data shows that RAS specific T cells recognize mutated cells and upregulate cytotoxic machinery.
Figure 5B:
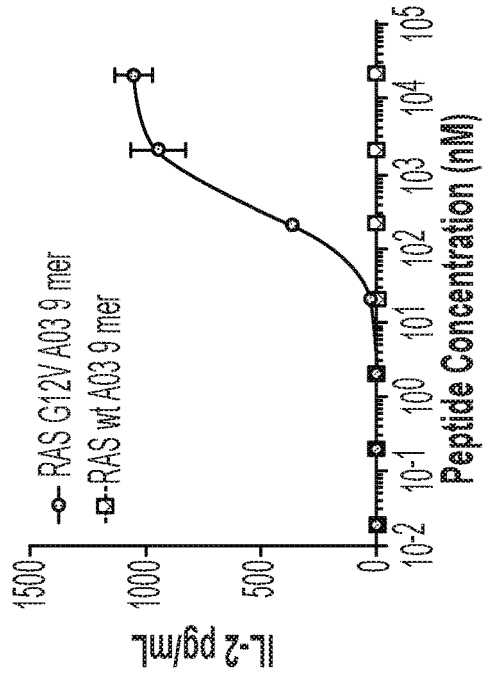
FIG. 5B is a graph showing antigen-specific induction of IL-2 by co-culturing T cells expressing a TCR specific to a 9mer or 11mer mutant RAS peptide with target cells loaded with increasing concentrations of a mutant RAS peptide. The data shows that RAS specific T cells recognize mutated cells and upregulate cytotoxic machinery.
Figure 5C:
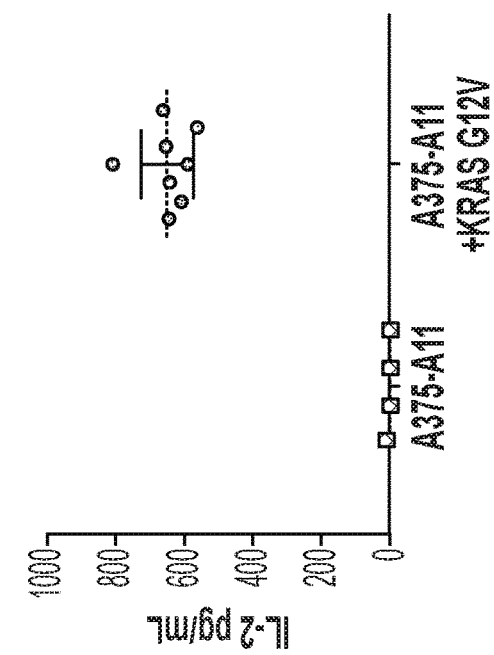
FIG. 5C is a graph showing antigen-specific induction of IL-2 by co-culturing T cells expressing a TCR specific to a mutant RAS peptide with 9mer mutant RAS peptide-transduced target cells. The data shows that RAS specific T cells recognize mutated cells and upregulate cytotoxic machinery.
Figure 5D:
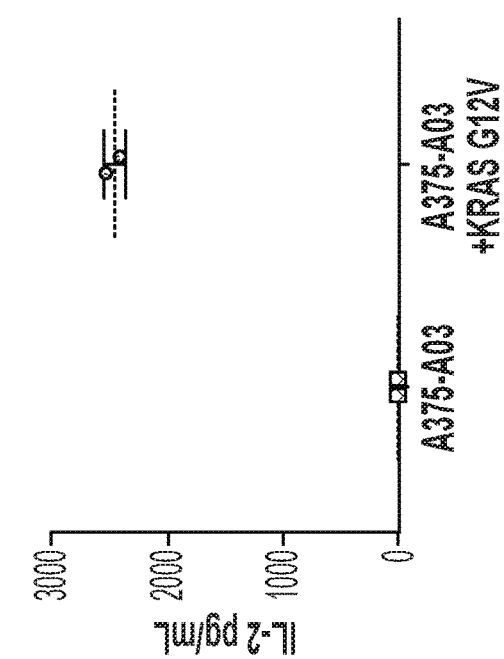
FIG. 5D is a graph showing antigen-specific induction of IL-2 by co-culturing T cells expressing a TCR specific to a 9mer mutant RAS peptide with target cells loaded with increasing concentrations of a mutant RAS peptide. The data shows that RAS specific T cells recognize mutated cells and upregulate cytotoxic machinery.
Figure 6:
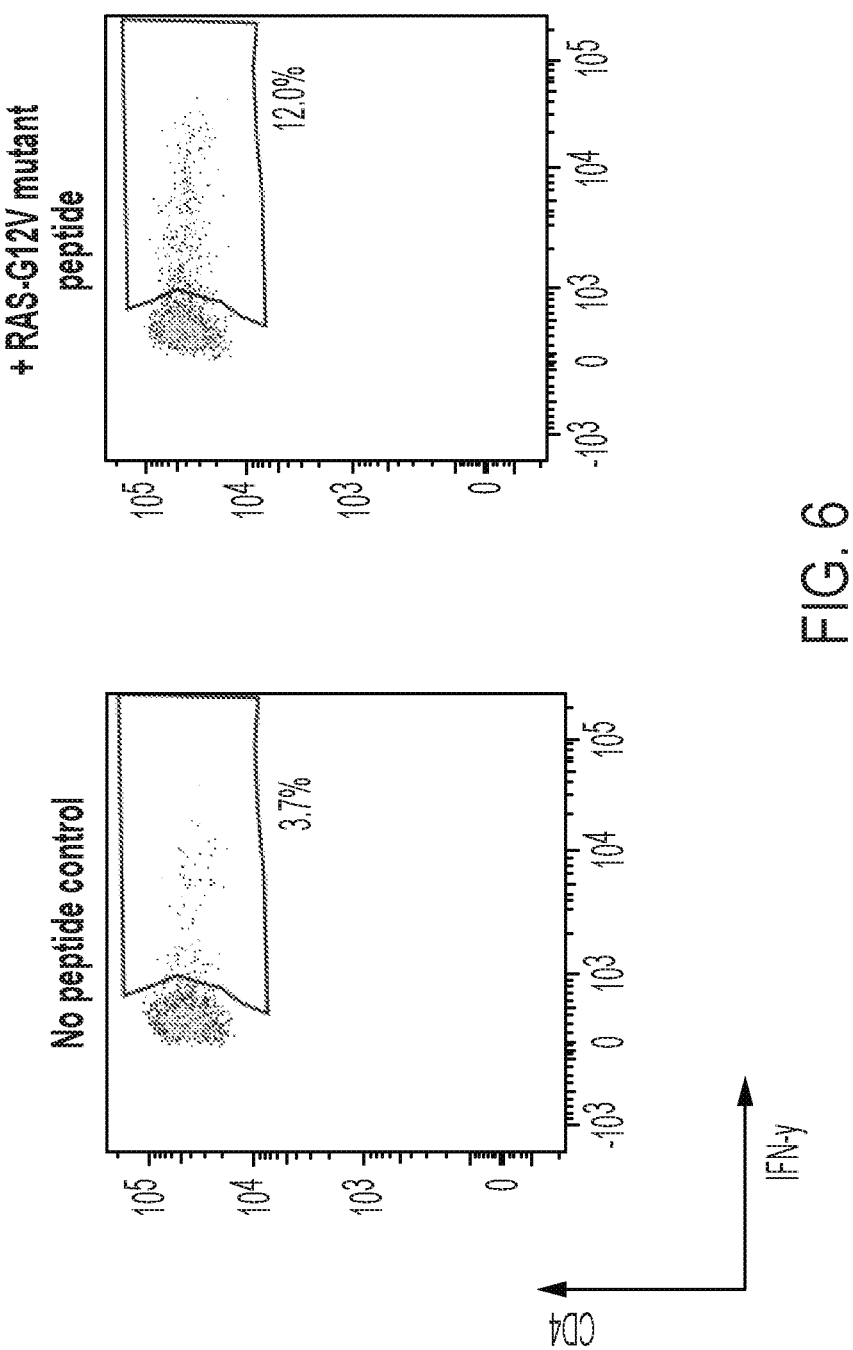
FIG. 6 depicts a FACS analysis of antigen-specific induction of IFNγ levels of CD4+ cells from a healthy donor stimulated with APCs loaded with or without a mutant RAS peptide.

A cytotoxicity assay was used to assess whether the induced T cell cultures can kill antigen expressing tumor lines. In this example, expression of active caspase 3 on alive and dead tumor cells was measured to quantify early cell death and dead tumor cells. In FIG. 4B, the induced CD8+ responses were capable of killing antigen expressing tumor targets. The percent live caspase-A positive target cells of samples mock transduced or transduced with a lentiviral expression vector encoding a mutant RAS peptide is shown.

Example 12—Mutant KRAS Peptide Stablemers Produce Strong Epitopes on Multiple Alleles Multiple peptides containing the neoepitopes in the table below were expressed or loaded onto antigen presenting cells (APCs). Mass spectrometry was then performed and the affinity of the neoepitopes for the indicated HLA alleles and stability of the neoepitopes with the HLA alleles was determined.

| Gene | Class | HLA Allele | SEQ ID NO: | Peptide Sequence | Predicted affinity (nM) | Measured Affinity (nM) | Measured stability (hr) |
|---|---|---|---|---|---|---|---|
| KRAS, G12C | Neoepitope | A02.01 | 2295 | KLVVVGACGV | 203.6 | 70.3 | 1.0 |
| KRAS, G12C | Affinity Enh. | A02.01 | 2296 | FLVVVGACGL | 181.8 | 69.4 | 1.4 |
| KRAS, G12C | Affinity Enh. | A02.01 | 2297 | FMVVVGACGI | 173.8 | 17.0 | 1.0 |
| KRAS, G12C | Affinity Enh. | A02.01 | 2298 | FLVVVGACGI | 194.9 | 27.8 | 1.4 |
| KRAS, G12C | Affinity Enh. | A02.01 | 2299 | FMVVVGACGV | 53.2 | 1.1 | 5.4 |
| KRAS, G12C | Affinity Enh. | A02.01 | 2300 | FLVVVGACGV | 61.6 | 4.2 | 7.4 |
| KRAS, G12C | Affinity Enh. | A02.01 | 2301 | MLVVVGACGV | 117.7 | 18.2 | 1.7 |
| KRAS, G12C | Affinity Enh. | A02.01 | 2302 | FMVVVGACGL | 167.3 | 85.3 | 0.9 |
| KRAS, G12C | Affinity Enh. | A02.01 | 2303 | YLVVVGACGV | 80.7 | 3.9 | 9.3 |
| KRAS, G12C | Affinity Enh. | A02.01 | 2304 | KMVVVGACGV | 189.3 | 11.9 | 3.8 |
| KRAS, G12C | Affinity Enh. | A02.01 | 2305 | YMVVVGACGV | 70.1 | 7.0 | 6.4 |
| KRAS, G12C | Affinity Enh. | A02.01 | 2306 | MMVVVGACGV | 95.8 | 18.9 | 2.1 |

SEQUENCE LISTING (2567 sequences)

SEQ ID NO: 1 - protein, 10 aa, Artificial Sequence
  Description of Artificial Sequence: Synthetic peptide
KLVVVGADGV

SEQ ID NO: 2 - protein, 10 aa, Artificial Sequence
  Description of Artificial Sequence: Synthetic peptide
KLVVVGACGV

SEQ ID NO: 3 - protein, 10 aa, Artificial Sequence
  Description of Artificial Sequence: Synthetic peptide
KLVVVGAVGV

SEQ ID NO: 4 - protein, 9 aa, Artificial Sequence
  Description of Artificial Sequence: Synthetic peptide
LVVVGADGV

SEQ ID NO: 5 - protein, 9 aa, Artificial Sequence
  Description of Artificial Sequence: Synthetic peptide
LVVVGACGV

SEQ ID NO: 6 - protein, 9 aa, Artificial Sequence
  Description of Artificial Sequence: Synthetic peptide
LVVVGAVGV

SEQ ID NO: 7 - protein, 10 aa, Artificial Sequence
  Description of Artificial Sequence: Synthetic peptide
GADGVGKSAL

SEQ ID NO: 8 - protein, 10 aa, Artificial Sequence
  Description of Artificial Sequence: Synthetic peptide
GACGVGKSAL

SEQ ID NO: 9 - protein, 10 aa, Artificial Sequence
  Description of Artificial Sequence: Synthetic peptide
GAVGVGKSAL

SEQ ID NO: 10 - protein, 9 aa, Artificial Sequence
  Description of Artificial Sequence: Synthetic peptide
GADGVGKSA

SEQ ID NO: 11 - protein, 9 aa, Artificial Sequence
  Description of Artificial Sequence: Synthetic peptide
GACGVGKSA

SEQ ID NO: 12 - protein, 9 aa, Artificial Sequence
  Description of Artificial Sequence: Synthetic peptide
GAVGVGKSA

SEQ ID NO: 13 - protein, 9 aa, Artificial Sequence
  Description of Artificial Sequence: Synthetic peptide
VVGADGVGK

SEQ ID NO: 14 - protein, 9 aa, Artificial Sequence
  Description of Artificial Sequence: Synthetic peptide
VVGACGVGK

SEQ ID NO: 15 - protein, 9 aa, Artificial Sequence
  Description of Artificial Sequence: Synthetic peptide
VVGAVGVGK

SEQ ID NO: 16 - protein, 10 aa, Artificial Sequence
  Description of Artificial Sequence: Synthetic peptide
VVVGADGVGK

SEQ ID NO: 17 - protein, 10 aa, Artificial Sequence
  Description of Artificial Sequence: Synthetic peptide
VVVGACGVGK

SEQ ID NO: 18 - protein, 10 aa, Artificial Sequence
  Description of Artificial Sequence: Synthetic peptide
VVVGAVGVGK

SEQ ID NO: 19 - protein, 15 aa, Artificial Sequence
  Description of Artificial Sequence: Synthetic peptide
  MOD_RES (8)..(8): Asp, Val, Cys, Ala, Arg or Ser
KLVVVGAXGVGKSAL

SEQ ID NO: 20 - protein, 19 aa, Artificial Sequence
  Description of Artificial Sequence: Synthetic peptide
KLVVVGAVGVGKSALTIQL

SEQ ID NO: 21 - protein, 10 aa, Artificial Sequence
  Description of Artificial Sequence: Synthetic peptide
  MOD_RES (1)..(1): Any amino acid except Ala
  MOD_RES (2)..(2): Any amino acid except Glu
  MOD_RES (8)..(8): Asp, Val, Cys, Ala, Arg or Ser
  MOD_RES (10)..(10): Any amino acid
  See specification as filed for detailed description of substitutions and preferred embodiments
XXVVVGAXGX

SEQ ID NO: 22 - protein, 8 aa, Artificial Sequence
  Description of Artificial Sequence: Synthetic peptide
DTAGHEEY

SEQ ID NO: 23 - protein, 10 aa, Artificial Sequence
  Description of Artificial Sequence: Synthetic peptide
TAGHEEYSAM

SEQ ID NO: 24 - protein, 9 aa, Artificial Sequence
  Description of Artificial Sequence: Synthetic peptide
DILDTAGHE

SEQ ID NO: 25 - protein, 8 aa, Artificial Sequence
  Description of Artificial Sequence: Synthetic peptide
DILDTAGH

SEQ ID NO: 26 - protein, 9 aa, Artificial Sequence
  Description of Artificial Sequence: Synthetic peptide
ILDTAGHEE

SEQ ID NO: 27 - protein, 8 aa, Artificial Sequence
  Description of Artificial Sequence: Synthetic peptide
ILDTAGHE

SEQ ID NO: 28 - protein, 11 aa, Artificial Sequence
  Description of Artificial Sequence: Synthetic peptide
DILDTAGHEEY

SEQ ID NO: 29 - protein, 9 aa, Artificial Sequence
  Description of Artificial Sequence: Synthetic peptide
DTAGHEEYS

SEQ ID NO: 30 - protein, 10 aa, Artificial Sequence
  Description of Artificial Sequence: Synthetic peptide
LLDILDTAGH

SEQ ID NO: 31 - protein, 9 aa, Artificial Sequence
  Description of Artificial Sequence: Synthetic peptide
DILDTAGRE

SEQ ID NO: 32 - protein, 8 aa, Artificial Sequence
  Description of Artificial Sequence: Synthetic peptide
DILDTAGR

SEQ ID NO: 33 - protein, 9 aa, Artificial Sequence
  Description of Artificial Sequence: Synthetic peptide
ILDTAGREE

SEQ ID NO: 34 - protein, 8 aa, Artificial Sequence
  Description of Artificial Sequence: Synthetic peptide
ILDTAGRE

SEQ ID NO: 35 - protein, 11 aa, Artificial Sequence
  Description of Artificial Sequence: Synthetic peptide
CLLDILDTAGR

SEQ ID NO: 36 - protein, 10 aa, Artificial Sequence
  Description of Artificial Sequence: Synthetic peptide
TAGREEYSAM

SEQ ID NO: 37 - protein, 9 aa, Artificial Sequence
  Description of Artificial Sequence: Synthetic peptide
REEYSAMRD

SEQ ID NO: 38 - protein, 11 aa, Artificial Sequence
  Description of Artificial Sequence: Synthetic peptide
DTAGKEEYSAM

SEQ ID NO: 39 - protein, 11 aa, Artificial Sequence
  Description of Artificial Sequence: Synthetic peptide
CLLDILDTAGK

SEQ ID NO: 40 - protein, 8 aa, Artificial Sequence
  Description of Artificial Sequence: Synthetic peptide
DTAGKEEY

SEQ ID NO: 41 - protein, 10 aa, Artificial Sequence
  Description of Artificial Sequence: Synthetic peptide
LLDILDTAGK

SEQ ID NO: 42 - protein, 8 aa, Artificial Sequence
  Description of Artificial Sequence: Synthetic peptide
ILDTAGKE

SEQ ID NO: 43 - protein, 9 aa, Artificial Sequence
  Description of Artificial Sequence: Synthetic peptide
ILDTAGKEE

SEQ ID NO: 44 - protein, 8 aa, Artificial Sequence
  Description of Artificial Sequence: Synthetic peptide
DTAGLEEY

SEQ ID NO: 45 - protein, 8 aa, Artificial Sequence
  Description of Artificial Sequence: Synthetic peptide
ILDTAGLE

SEQ ID NO: 46 - protein, 8 aa, Artificial Sequence
  Description of Artificial Sequence: Synthetic peptide
DILDTAGL

SEQ ID NO: 47 - protein, 9 aa, Artificial Sequence
  Description of Artificial Sequence: Synthetic peptide
ILDTAGLEE

SEQ ID NO: 48 - protein, 12 aa, Artificial Sequence
  Description of Artificial Sequence: Synthetic peptide
GLEEYSAMRDQY

SEQ ID NO: 49 - protein, 11 aa, Artificial Sequence
  Description of Artificial Sequence: Synthetic peptide
LLDILDTAGLE

SEQ ID NO: 50 - protein, 9 aa, Artificial Sequence
  Description of Artificial Sequence: Synthetic peptide
LDILDTAGL

SEQ ID NO: 51 - protein, 9 aa, Artificial Sequence
  Description of Artificial Sequence: Synthetic peptide
DILDTAGLE

SEQ ID NO: 52 - protein, 11 aa, Artificial Sequence
  Description of Artificial Sequence: Synthetic peptide
DILDTAGLEEY

SEQ ID NO: 53 - protein, 8 aa, Artificial Sequence
  Description of Artificial Sequence: Synthetic peptide
AGVGKSAL

SEQ ID NO: 54 - protein, 10 aa, Artificial Sequence
  Description of Artificial Sequence: Synthetic peptide
GAAGVGKSAL

SEQ ID NO: 55 - protein, 9 aa, Artificial Sequence
  Description of Artificial Sequence: Synthetic peptide
AAGVGKSAL

SEQ ID NO: 56 - protein, 8 aa, Artificial Sequence
  Description of Artificial Sequence: Synthetic peptide
CGVGKSAL

SEQ ID NO: 57 - protein, 9 aa, Artificial Sequence
  Description of Artificial Sequence: Synthetic peptide
ACGVGKSAL

SEQ ID NO: 58 - protein, 8 aa, Artificial Sequence
  Description of Artificial Sequence: Synthetic peptide
DGVGKSAL

SEQ ID NO: 59 - protein, 9 aa, Artificial Sequence
  Description of Artificial Sequence: Synthetic peptide
ADGVGKSAL

SEQ ID NO: 60 - protein, 10 aa, Artificial Sequence
  Description of Artificial Sequence: Synthetic peptide
DGVGKSALTI

SEQ ID NO: 61 - protein, 9 aa, Artificial Sequence
  Description of Artificial Sequence: Synthetic peptide
GARGVGKSA

SEQ ID NO: 62 - protein, 10 aa, Artificial Sequence
  Description of Artificial Sequence: Synthetic peptide
KLVVVGARGV

SEQ ID NO: 63 - protein, 8 aa, Artificial Sequence
  Description of Artificial Sequence: Synthetic peptide
VVVGARGV

SEQ ID NO: 64 - protein, 8 aa, Artificial Sequence
  Description of Artificial Sequence: Synthetic peptide
SGVGKSAL

SEQ ID NO: 65 - protein, 10 aa, Artificial Sequence
  Description of Artificial Sequence: Synthetic peptide
VVVGASGVGK

SEQ ID NO: 66 - protein, 10 aa, Artificial Sequence
  Description of Artificial Sequence: Synthetic peptide
GASGVGKSAL

SEQ ID NO: 67 - protein, 8 aa, Artificial Sequence
  Description of Artificial Sequence: Synthetic peptide
VGVGKSAL

SEQ ID NO: 68 - protein, 10 aa, Artificial Sequence
  Description of Artificial Sequence: Synthetic peptide
VVVGAGCVGK

SEQ ID NO: 69 - protein, 9 aa, Artificial Sequence
  Description of Artificial Sequence: Synthetic peptide
KLVVVGAGC

SEQ ID NO: 70 - protein, 8 aa, Artificial Sequence
  Description of Artificial Sequence: Synthetic peptide
GDVGKSAL

SEQ ID NO: 71 - protein, 9 aa, Artificial Sequence
  Description of Artificial Sequence: Synthetic peptide
DVGKSALTI

SEQ ID NO: 72 - protein, 10 aa, Artificial Sequence
  Description of Artificial Sequence: Synthetic peptide
VVVGAGDVGK

SEQ ID NO: 73 - protein, 10 aa, Artificial Sequence
  Description of Artificial Sequence: Synthetic peptide
TAGKEEYSAM

SEQ ID NO: 74 - protein, 11 aa, Artificial Sequence
  Description of Artificial Sequence: Synthetic peptide
DTAGHEEYSAM

SEQ ID NO: 75 - protein, 9 aa, Artificial Sequence
  Description of Artificial Sequence: Synthetic peptide
TAGHEEYSA

SEQ ID NO: 76 - protein, 11 aa, Artificial Sequence
  Description of Artificial Sequence: Synthetic peptide
DTAGREEYSAM

SEQ ID NO: 77 - protein, 9 aa, Artificial Sequence
  Description of Artificial Sequence: Synthetic peptide
TAGKEEYSA

SEQ ID NO: 78 - protein, 8 aa, Artificial Sequence
  Description of Artificial Sequence: Synthetic peptide
AAGVGKSA

SEQ ID NO: 79 - protein, 9 aa, Artificial Sequence
  Description of Artificial Sequence: Synthetic peptide
AGCVGKSAL

SEQ ID NO: 80 - protein, 9 aa, Artificial Sequence
  Description of Artificial Sequence: Synthetic peptide
AGDVGKSAL

SEQ ID NO: 81 - protein, 10 aa, Artificial Sequence
  Description of Artificial Sequence: Synthetic peptide
AGKEEYSAMR

SEQ ID NO: 82 - protein, 10 aa, Artificial Sequence
  Description of Artificial Sequence: Synthetic peptide
AGVGKSALTI

SEQ ID NO: 83 - protein, 9 aa, Artificial Sequence
  Description of Artificial Sequence: Synthetic peptide
ARGVGKSAL

SEQ ID NO: 84 - protein, 8 aa, Artificial Sequence
  Description of Artificial Sequence: Synthetic peptide
ASGVGKSA

SEQ ID NO: 85 - protein, 9 aa, Artificial Sequence
  Description of Artificial Sequence: Synthetic peptide
ASGVGKSAL

SEQ ID NO: 86 - protein, 8 aa, Artificial Sequence
  Description of Artificial Sequence: Synthetic peptide
AVGVGKSA

SEQ ID NO: 87 - protein, 9 aa, Artificial Sequence
  Description of Artificial Sequence: Synthetic peptide
CVGKSALTI

SEQ ID NO: 88 - protein, 8 aa, Artificial Sequence
  Description of Artificial Sequence: Synthetic peptide
DILDTAGK

SEQ ID NO: 89 - protein, 11 aa, Artificial Sequence
  Description of Artificial Sequence: Synthetic peptide
DILDTAGREEY

SEQ ID NO: 90 - protein, 12 aa, Artificial Sequence
  Description of Artificial Sequence: Synthetic peptide
DTAGHEEYSAMR

SEQ ID NO: 91 - protein, 9 aa, Artificial Sequence
  Description of Artificial Sequence: Synthetic peptide
DTAGKEEYS

SEQ ID NO: 92 - protein, 12 aa, Artificial Sequence
  Description of Artificial Sequence: Synthetic peptide
DTAGKEEYSAMR

SEQ ID NO: 93 - protein, 9 aa, Artificial Sequence
  Description of Artificial Sequence: Synthetic peptide
DTAGLEEYS

SEQ ID NO: 94 - protein, 10 aa, Artificial Sequence
  Description of Artificial Sequence: Synthetic peptide
DTAGLEEYSA

SEQ ID NO: 95 - protein, 12 aa, Artificial Sequence
  Description of Artificial Sequence: Synthetic peptide
DTAGLEEYSAMR

SEQ ID NO: 96 - protein, 9 aa, Artificial Sequence
  Description of Artificial Sequence: Synthetic peptide
DTAGREEYS

SEQ ID NO: 97 - protein, 12 aa, Artificial Sequence
  Description of Artificial Sequence: Synthetic peptide
DTAGREEYSAMR

SEQ ID NO: 98 - protein, 9 aa, Artificial Sequence
  Description of Artificial Sequence: Synthetic peptide
GAAGVGKSA

SEQ ID NO: 99 - protein, 9 aa, Artificial Sequence
  Description of Artificial Sequence: Synthetic peptide
GACGVGKSA

SEQ ID NO: 100 - protein, 10 aa, Artificial Sequence
  Description of Artificial Sequence: Synthetic peptide
GACGVGKSAL

SEQ ID NO: 101 - protein, 8 aa, Artificial Sequence
  Description of Artificial Sequence: Synthetic peptide
GADGVGKS

SEQ ID NO: 102 - protein, 9 aa, Artificial Sequence
  Description of Artificial Sequence: Synthetic peptide
GAGDVGKSA

SEQ ID NO: 103 - protein, 10 aa, Artificial Sequence
  Description of Artificial Sequence: Synthetic peptide
GAGDVGKSAL

SEQ ID NO: 104 - protein, 9 aa, Artificial Sequence
  Description of Artificial Sequence: Synthetic peptide
GASGVGKSA

SEQ ID NO: 105 - protein, 8 aa, Artificial Sequence
  Description of Artificial Sequence: Synthetic peptide
GCVGKSAL

SEQ ID NO: 106 - protein, 10 aa, Artificial Sequence
  Description of Artificial Sequence: Synthetic peptide
GCVGKSALTI

SEQ ID NO: 107 - protein, 8 aa, Artificial Sequence
  Description of Artificial Sequence: Synthetic peptide
GHEEYSAM

SEQ ID NO: 108 - protein, 8 aa, Artificial Sequence
  Description of Artificial Sequence: Synthetic peptide
GKEEYSAM

SEQ ID NO: 109 - protein, 9 aa, Artificial Sequence
  Description of Artificial Sequence: Synthetic peptide
GLEEYSAMR

SEQ ID NO: 110 - protein, 8 aa, Artificial Sequence
  Description of Artificial Sequence: Synthetic peptide
GREEYSAM

SEQ ID NO: 111 - protein, 9 aa, Artificial Sequence
  Description of Artificial Sequence: Synthetic peptide
GREEYSAMR

SEQ ID NO: 112 - protein, 9 aa, Artificial Sequence
  Description of Artificial Sequence: Synthetic peptide
HEEYSAMRD

SEQ ID NO: 113 - protein, 9 aa, Artificial Sequence
  Description of Artificial Sequence: Synthetic peptide
KEEYSAMRD

SEQ ID NO: 114 - protein, 9 aa, Artificial Sequence
  Description of Artificial Sequence: Synthetic peptide
KLVVVGASG

SEQ ID NO: 115 - protein, 9 aa, Artificial Sequence
  Description of Artificial Sequence: Synthetic peptide
LDILDTAGR

SEQ ID NO: 116 - protein, 9 aa, Artificial Sequence
  Description of Artificial Sequence: Synthetic peptide
LEEYSAMRD

SEQ ID NO: 117 - protein, 9 aa, Artificial Sequence
  Description of Artificial Sequence: Synthetic peptide
LVVVGARGV

SEQ ID NO: 118 - protein, 9 aa, Artificial Sequence
  Description of Artificial Sequence: Synthetic peptide
LVVVGASGV

SEQ ID NO: 119 - protein, 11 aa, Artificial Sequence
  Description of Artificial Sequence: Synthetic peptide
REEYSAMRDQY

SEQ ID NO: 120 - protein, 8 aa, Artificial Sequence
  Description of Artificial Sequence: Synthetic peptide
RGVGKSAL

SEQ ID NO: 121 - protein, 9 aa, Artificial Sequence
  Description of Artificial Sequence: Synthetic peptide
TAGLEEYSA

SEQ ID NO: 122 - protein, 11 aa, Artificial Sequence
  Description of Artificial Sequence: Synthetic peptide
TEYKLVVVGAA

SEQ ID NO: 123 - protein, 10 aa, Artificial Sequence
  Description of Artificial Sequence: Synthetic peptide
VGAAGVGKSA

SEQ ID NO: 124 - protein, 8 aa, Artificial Sequence
  Description of Artificial Sequence: Synthetic peptide
VGADGVGK

SEQ ID NO: 125 - protein, 10 aa, Artificial Sequence
  Description of Artificial Sequence: Synthetic peptide
VGASGVGKSA

SEQ ID NO: 126 - protein, 10 aa, Artificial Sequence
  Description of Artificial Sequence: Synthetic peptide
VGVGKSALTI

SEQ ID NO: 127 - protein, 8 aa, Artificial Sequence
  Description of Artificial Sequence: Synthetic peptide
VVVGAAGV

SEQ ID NO: 128 - protein, 8 aa, Artificial Sequence
  Description of Artificial Sequence: Synthetic peptide
VVVGAVGV

SEQ ID NO: 129 - protein, 9 aa, Artificial Sequence
  Description of Artificial Sequence: Synthetic peptide
YKLVVVGAC

SEQ ID NO: 130 - protein, 9 aa, Artificial Sequence
  Description of Artificial Sequence: Synthetic peptide
YKLVVVGAD

SEQ ID NO: 131 - protein, 9 aa, Artificial Sequence
  Description of Artificial Sequence: Synthetic peptide
YKLVVVGAR

SEQ ID NO: 132 - protein, 9 aa, Artificial Sequence
  Description of Artificial Sequence: Synthetic peptide
DILDTAGKE

SEQ ID NO: 133 - protein, 9 aa, Artificial Sequence
  Description of Artificial Sequence: Synthetic peptide
LVVVGACGV

SEQ ID NO: 134 - protein, 10 aa, Artificial Sequence
  Description of Artificial Sequence: Synthetic peptide
KLVVVGACGV

SEQ ID NO: 135 - protein, 9 aa, Artificial Sequence
  Description of Artificial Sequence: Synthetic peptide
LVVVGADGV

SEQ ID NO: 136 - protein, 10 aa, Artificial Sequence
  Description of Artificial Sequence: Synthetic peptide
KLVVVGADGV

SEQ ID NO: 137 - protein, 9 aa, Artificial Sequence
  Description of Artificial Sequence: Synthetic peptide
LVVVGAVGV

SEQ ID NO: 138 - protein, 10 aa, Artificial Sequence
  Description of Artificial Sequence: Synthetic peptide
KLVVVGAVGV

SEQ ID NO: 139 - protein, 9 aa, Artificial Sequence
  Description of Artificial Sequence: Synthetic peptide
VVGACGVGK

SEQ ID NO: 140 - protein, 10 aa, Artificial Sequence
  Description of Artificial Sequence: Synthetic peptide
VVVGACGVGK

SEQ ID NO: 141 - protein, 9 aa, Artificial Sequence
  Description of Artificial Sequence: Synthetic peptide
VVGADGVGK

SEQ ID NO: 142 - protein, 10 aa, Artificial Sequence
  Description of Artificial Sequence: Synthetic peptide
VVVGADGVGK

SEQ ID NO: 143 - protein, 9 aa, Artificial Sequence
  Description of Artificial Sequence: Synthetic peptide
VVGAVGVGK

SEQ ID NO: 144 - protein, 10 aa, Artificial Sequence
  Description of Artificial Sequence: Synthetic peptide
VVVGAVGVGK

SEQ ID NO: 145 - protein, 9 aa, Artificial Sequence
  Description of Artificial Sequence: Synthetic peptide
VVGACGVGK

SEQ ID NO: 146 - protein, 9 aa, Artificial Sequence
  Description of Artificial Sequence: Synthetic peptide
VVGADGVGK

SEQ ID NO: 147 - protein, 10 aa, Artificial Sequence
  Description of Artificial Sequence: Synthetic peptide
VVVGADGVGK

SEQ ID NO: 148 - protein, 9 aa, Artificial Sequence
  Description of Artificial Sequence: Synthetic peptide
VVGAVGVGK

SEQ ID NO: 149 - protein, 10 aa, Artificial Sequence
  Description of Artificial Sequence: Synthetic peptide
VVVGAVGVGK

SEQ ID NO: 150 - protein, 10 aa, Artificial Sequence
  Description of Artificial Sequence: Synthetic peptide
KLVVVGACGV

SEQ ID NO: 151 - protein, 10 aa, Artificial Sequence
  Description of Artificial Sequence: Synthetic peptide
FLVVVGACGL

SEQ ID NO: 152 - protein, 10 aa, Artificial Sequence
  Description of Artificial Sequence: Synthetic peptide
FMVVVGACGI

SEQ ID NO: 153 - protein, 10 aa, Artificial Sequence
  Description of Artificial Sequence: Synthetic peptide
FLVVVGACGI

SEQ ID NO: 154 - protein, 10 aa, Artificial Sequence
  Description of Artificial Sequence: Synthetic peptide
FMVVVGACGV

SEQ ID NO: 155 - protein, 10 aa, Artificial Sequence
  Description of Artificial Sequence: Synthetic peptide
FLVVVGACGV

SEQ ID NO: 156 - protein, 10 aa, Artificial Sequence
  Description of Artificial Sequence: Synthetic peptide
MLVVVGACGV

SEQ ID NO: 157 - protein, 10 aa, Artificial Sequence
  Description of Artificial Sequence: Synthetic peptide
FMVVVGACGL

SEQ ID NO: 158 - protein, 10 aa, Artificial Sequence
  Description of Artificial Sequence: Synthetic peptide
YLVVVGACGV

SEQ ID NO: 159 - protein, 10 aa, Artificial Sequence
  Description of Artificial Sequence: Synthetic peptide
KMVVVGACGV

SEQ ID NO: 160 - protein, 10 aa, Artificial Sequence
  Description of Artificial Sequence: Synthetic peptide
YMVVVGACGV

SEQ ID NO: 161 - protein, 10 aa, Artificial Sequence
  Description of Artificial Sequence: Synthetic peptide
MMVVVGACGV

SEQ ID NO: 162 - protein, 13 aa, Artificial Sequence
  Description of Artificial Sequence: Synthetic peptide
TEYKLVVVGAVGV

SEQ ID NO: 163 - protein, 26 aa, Artificial Sequence
  Description of Artificial Sequence: Synthetic peptide
WQAGILARKLVVVGAVGVQGQNLKYQ

SEQ ID NO: 164 - protein, 25 aa, Artificial Sequence
  Description of Artificial Sequence: Synthetic peptide
HSYTTAEKLVVVGAVGVILGVLLLI

SEQ ID NO: 165 - protein, 26 aa, Artificial Sequence
  Description of Artificial Sequence: Synthetic peptide
PLTEEKIKKLVVVGAVGVEKEGKISK

SEQ ID NO: 166 - protein, 30 aa, Artificial Sequence
  Description of Artificial Sequence: Synthetic polypeptide
GALHFKPGSRKLVVVGAVGVAASDFIFLVT

SEQ ID NO: 167 - protein, 30 aa, Artificial Sequence
  Description of Artificial Sequence: Synthetic polypeptide
RRANKDATAEKLVVVGAVGVKELKQVASPF

SEQ ID NO: 168 - protein, 30 aa, Artificial Sequence
  Description of Artificial Sequence: Synthetic polypeptide
KAFISHEEKRKLVVVGAVGVKKKLINEKKE

SEQ ID NO: 169 - protein, 30 aa, Artificial Sequence
  Description of Artificial Sequence: Synthetic polypeptide
TDLSSRFSKSKLVVVGAVGVKKCDISLQFF

SEQ ID NO: 170 - protein, 30 aa, Artificial Sequence
  Description of Artificial Sequence: Synthetic polypeptide
FDLGGGTFDVKLVVVGAVGVKSTAGDTHLG

SEQ ID NO: 171 - protein, 30 aa, Artificial Sequence
  Description of Artificial Sequence: Synthetic polypeptide
CLLLHYSVSKKLVVVGAVGVATFYVAVTVP

SEQ ID NO: 172 - protein, 10 aa, Artificial Sequence
  Description of Artificial Sequence: Synthetic peptide
IDIIMKIRNA

SEQ ID NO: 173 - protein, 30 aa, Artificial Sequence
  Description of Artificial Sequence: Synthetic polypeptide
FFFFFFFFFFFFFFFFFFFFIIFFIFFWMC

SEQ ID NO: 174 - protein, 30 aa, Artificial Sequence
  Description of Artificial Sequence: Synthetic polypeptide
FFFFFFFFFFFFFFFFFFFFFFFFAAFWFW

SEQ ID NO: 175 - protein, 30 aa, Artificial Sequence
  Description of Artificial Sequence: Synthetic polypeptide
IFFIFFIIFFFFFFFFFFFFIIIIIIIWEC

SEQ ID NO: 176 - protein, 30 aa, Artificial Sequence
  Description of Artificial Sequence: Synthetic polypeptide
FIFFFIIFFFFFIFFFFFIFIIIIIIFWEC

SEQ ID NO: 177 - protein, 8 aa, Artificial Sequence
  Description of Artificial Sequence: Synthetic peptide
WQAGILAR

SEQ ID NO: 178 - protein, 7 aa, Artificial Sequence
  Description of Artificial Sequence: Synthetic peptide
HSYTTAE

SEQ ID NO: 179 - protein, 8 aa, Artificial Sequence
  Description of Artificial Sequence: Synthetic peptide
PLTEEKIK

SEQ ID NO: 180 - protein, 10 aa, Artificial Sequence
  Description of Artificial Sequence: Synthetic peptide
GALHFKPGSR

SEQ ID NO: 181 - protein, 10 aa, Artificial Sequence
  Description of Artificial Sequence: Synthetic peptide
RRANKDATAE

SEQ ID NO: 182 - protein, 10 aa, Artificial Sequence
  Description of Artificial Sequence: Synthetic peptide
KAFISHEEKR

SEQ ID NO: 183 - protein, 10 aa, Artificial Sequence
  Description of Artificial Sequence: Synthetic peptide
TDLSSRFSKS

SEQ ID NO: 184 - protein, 10 aa, Artificial Sequence
  Description of Artificial Sequence: Synthetic peptide
FDLGGGTFDV

SEQ ID NO: 185 - protein, 10 aa, Artificial Sequence
  Description of Artificial Sequence: Synthetic peptide
CLLLHYSVSK

SEQ ID NO: 186 - protein, 9 aa, Artificial Sequence
  Description of Artificial Sequence: Synthetic peptide
MTEYKLVVV

SEQ ID NO: 187 - protein, 10 aa, Artificial Sequence
  Description of Artificial Sequence: Synthetic peptide
KKNKKDDIKD

SEQ ID NO: 188 - protein, 30 aa, Artificial Sequence
  Description of Artificial Sequence: Synthetic polypeptide
AGNDDDDDDDDDDDDDDDDDKKDKDDDDDD

SEQ ID NO: 189 - protein, 30 aa, Artificial Sequence
  Description of Artificial Sequence: Synthetic polypeptide
AGNKKKKKKKNNNNNNNNNNNNNNNNNNNN

SEQ ID NO: 190 - protein, 30 aa, Artificial Sequence
  Description of Artificial Sequence: Synthetic polypeptide
AGRDDDDDDDDDDDDDDDDDDDDDDDDDDD

SEQ ID NO: 191 - protein, 9 aa, Artificial Sequence
  Description of Artificial Sequence: Synthetic peptide
GKSALTIQL

SEQ ID NO: 192 - protein, 7 aa, Artificial Sequence
  Description of Artificial Sequence: Synthetic peptide
GKSALTI

SEQ ID NO: 193 - protein, 8 aa, Artificial Sequence
  Description of Artificial Sequence: Synthetic peptide
QGQNLKYQ

SEQ ID NO: 194 - protein, 8 aa, Artificial Sequence
  Description of Artificial Sequence: Synthetic peptide
ILGVLLLI

SEQ ID NO: 195 - protein, 8 aa, Artificial Sequence
  Description of Artificial Sequence: Synthetic peptide
EKEGKISK

SEQ ID NO: 196 - protein, 10 aa, Artificial Sequence
  Description of Artificial Sequence: Synthetic peptide
AASDFIFLVT

SEQ ID NO: 197 - protein, 10 aa, Artificial Sequence
  Description of Artificial Sequence: Synthetic peptide
KELKQVASPF

SEQ ID NO: 198 - protein, 10 aa, Artificial Sequence
  Description of Artificial Sequence: Synthetic peptide
KKKLINEKKE

SEQ ID NO: 199 - protein, 10 aa, Artificial Sequence
  Description of Artificial Sequence: Synthetic peptide
KKCDISLQFF

SEQ ID NO: 200 - protein, 10 aa, Artificial Sequence
  Description of Artificial Sequence: Synthetic peptide
KSTAGDTHLG

SEQ ID NO: 201 - protein, 10 aa, Artificial Sequence
  Description of Artificial Sequence: Synthetic peptide
ATFYVAVTVP

SEQ ID NO: 202 - protein, 30 aa, Artificial Sequence
  Description of Artificial Sequence: Synthetic polypeptide
LTIQLIQNHFVDEYDPTIEDSYRKQVVIDG

SEQ ID NO: 203 - protein, 30 aa, Artificial Sequence
  Description of Artificial Sequence: Synthetic polypeptide
TIQLIQNHFVDEYDPTIEDSYRKQVVIDGE

SEQ ID NO: 204 - protein, 9 aa, Artificial Sequence
  Description of Artificial Sequence: Synthetic peptide
VVGADGVGK

SEQ ID NO: 205 - protein, 9 aa, Artificial Sequence
  Description of Artificial Sequence: Synthetic peptide
VVGACGVGK

SEQ ID NO: 206 - protein, 9 aa, Artificial Sequence
  Description of Artificial Sequence: Synthetic peptide
VVGAVGVGK

SEQ ID NO: 207 - protein, 10 aa, Artificial Sequence
  Description of Artificial Sequence: Synthetic peptide
VVVGADGVGK

SEQ ID NO: 208 - protein, 10 aa, Artificial Sequence
  Description of Artificial Sequence: Synthetic peptide
VVVGACGVGK

SEQ ID NO: 209 - protein, 10 aa, Artificial Sequence
  Description of Artificial Sequence: Synthetic peptide
VVVGAVGVGK

SEQ ID NO: 210 - protein, 10 aa, Artificial Sequence
  Description of Artificial Sequence: Synthetic peptide
GADGVGKSAL

SEQ ID NO: 211 - protein, 10 aa, Artificial Sequence
  Description of Artificial Sequence: Synthetic peptide
GACGVGKSAL

SEQ ID NO: 212 - protein, 10 aa, Artificial Sequence
  Description of Artificial Sequence: Synthetic peptide
GAVGVGKSAL

SEQ ID NO: 213 - protein, 9 aa, Artificial Sequence
  Description of Artificial Sequence: Synthetic peptide
GADGVGKSA

SEQ ID NO: 214 - protein, 9 aa, Artificial Sequence
  Description of Artificial Sequence: Synthetic peptide
GACGVGKSA

SEQ ID NO: 215 - protein, 9 aa, Artificial Sequence
  Description of Artificial Sequence: Synthetic peptide
GAVGVGKSA

SEQ ID NO: 216 - protein, 10 aa, Artificial Sequence
  Description of Artificial Sequence: Synthetic peptide
KLVVVGADGV

SEQ ID NO: 217 - protein, 10 aa, Artificial Sequence
  Description of Artificial Sequence: Synthetic peptide
KLVVVGACGV

SEQ ID NO: 218 - protein, 10 aa, Artificial Sequence
  Description of Artificial Sequence: Synthetic peptide
KLVVVGAVGV

SEQ ID NO: 219 - protein, 9 aa, Artificial Sequence
  Description of Artificial Sequence: Synthetic peptide
LVVVGADGV

SEQ ID NO: 220 - protein, 9 aa, Artificial Sequence
  Description of Artificial Sequence: Synthetic peptide
LVVVGACGV

SEQ ID NO: 221 - protein, 9 aa, Artificial Sequence
  Description of Artificial Sequence: Synthetic peptide
LVVVGAVGV

SEQ ID NO: 222 - protein, 10 aa, Artificial Sequence
  Description of Artificial Sequence: Synthetic peptide
GADGVGKSAL

SEQ ID NO: 223 - protein, 10 aa, Artificial Sequence
  Description of Artificial Sequence: Synthetic peptide
GACGVGKSAL

SEQ ID NO: 224 - protein, 10 aa, Artificial Sequence
  Description of Artificial Sequence: Synthetic peptide
GAVGVGKSAL

SEQ ID NO: 225 - protein, 9 aa, Artificial Sequence
  Description of Artificial Sequence: Synthetic peptide
GADGVGKSA

SEQ ID NO: 226 - protein, 9 aa, Artificial Sequence
  Description of Artificial Sequence: Synthetic peptide
GACGVGKSA

SEQ ID NO: 227 - protein, 9 aa, Artificial Sequence
  Description of Artificial Sequence: Synthetic peptide
GAVGVGKSA

SEQ ID NO: 228 - protein, 9 aa, Artificial Sequence
  Description of Artificial Sequence: Synthetic peptide
VVGADGVGK

SEQ ID NO: 229 - protein, 9 aa, Artificial Sequence
  Description of Artificial Sequence: Synthetic peptide
VVGACGVGK

SEQ ID NO: 230 - protein, 9 aa, Artificial Sequence
  Description of Artificial Sequence: Synthetic peptide
VVGAVGVGK

SEQ ID NO: 231 - protein, 10 aa, Artificial Sequence
  Description of Artificial Sequence: Synthetic peptide
VVVGADGVGK

SEQ ID NO: 232 - protein, 10 aa, Artificial Sequence
  Description of Artificial Sequence: Synthetic peptide
VVVGACGVGK

SEQ ID NO: 233 - protein, 10 aa, Artificial Sequence
  Description of Artificial Sequence: Synthetic peptide
VVVGAVGVGK

SEQ ID NO: 234 - protein, 9 aa, Artificial Sequence
  Description of Artificial Sequence: Synthetic peptide
VVGASGVGK

SEQ ID NO: 235 - protein, 11 aa, Artificial Sequence
  Description of Artificial Sequence: Synthetic peptide
CLLDILDTAGK

SEQ ID NO: 236 - protein, 10 aa, Artificial Sequence
  Description of Artificial Sequence: Synthetic peptide
VVVGASGVGK

SEQ ID NO: 237 - protein, 10 aa, Artificial Sequence
  Description of Artificial Sequence: Synthetic peptide
GADGVGKSAL

SEQ ID NO: 238 - protein, 101 aa, Artificial Sequence
  Description of Artificial Sequence: Synthetic polypeptide
VADGLITTLHYPAPKRNKPTVYGVSPNYDKWEMERTDITMKHKLGGGQYGKVYEGVWKKYSLTVAVKTLKEDTMEVEEFLKEAAVMKEIKHPNLVQLLGVC

SEQ ID NO: 239 - protein, 101 aa, Artificial Sequence
  Description of Artificial Sequence: Synthetic polypeptide
VADGLITTLHYPAPKRNKPTVYGVSPNYDKWEMERTDITMKHKLGGGQYGVVYEGVWKKYSLTVAVKTLKEDTMEVEEFLKEAAVMKEIKHPNLVQLLGVC

SEQ ID NO: 240 - protein, 101 aa, Artificial Sequence
  Description of Artificial Sequence: Synthetic polypeptide
LLGVCTREPPFYIITEFMTYGNLLDYLRECNRQEVNAVVLLYMATQISSATEYLEKKNFIHRDLAARNCLVGENHLVKVADFGLSRLMTGDTYTAHAGAKF

SEQ ID NO: 241 - protein, 101 aa, Artificial Sequence
  Description of Artificial Sequence: Synthetic polypeptide
SLTVAVKTLKEDTMEVEEFLKEAAVMKEIKHPNLVQLLGVCTREPPFYIIIEFMTYGNLLDYLRECNRQEVNAVVLLYMATQISSAMEYLEKKNFIHRDLA

SEQ ID NO: 242 - protein, 101 aa, Artificial Sequence
  Description of Artificial Sequence: Synthetic polypeptide
STVADGLITTLHYPAPKRNKPTVYGVSPNYDKWEMERTDITMKHKLGGGQHGEVYEGVWKKYSLTVAVKTLKEDTMEVEEFLKEAAVMKEIKHPNLVQLLG

SEQ ID NO: 243 - protein, 101 aa, Artificial Sequence
  Description of Artificial Sequence: Synthetic polypeptide
SSLAMLDLLHVARDIACGCQYLEENHFIHRDIAARNCLLTCPGPGRVAKIADFGMARDIYRASYYRKGGCAMLPVKWMPPEAFMEGIFTSKTDTWSFGVLL

SEQ ID NO: 244 - protein, 101 aa, Artificial Sequence
  Description of Artificial Sequence: Synthetic polypeptide
QVAVKTLPEVCSEQDELDFLMEALIISKFNHQNIVRCIGVSLQSLPRFILMELMAGGDLKSFLRETRPRPSQPSSLAMLDLLHVARDIACGCQYLEENHFI

SEQ ID NO: 245 - protein, 101 aa, Artificial Sequence
  Description of Artificial Sequence: Synthetic polypeptide
MIKLIDIARQTAQGMDYLHAKSIIHRDLKSNNIFLHEDLTVKIGDFGLATEKSRWSGSHQFEQLSGSILWMAPEVIRMQDKNPYSFQSDVYAFGIVLYELM

SEQ ID NO: 246 - protein, 101 aa, Artificial Sequence
  Description of Artificial Sequence: Synthetic polypeptide
MIKEGSMSEDEFIEEAKVMMNLSHEKLVQLYGVCTKQRPIFIITEYMANGSLLNYLREMRHRFQTQQLLEMCKDVCEAMEYLESKQFLHRDLAARNCLVND

SEQ ID NO: 247 - protein, 93 aa, Artificial Sequence
  Description of Artificial Sequence: Synthetic polypeptide
MGFGDLKSPAGLQVLNDYLADKSYIEGYVPSQADVAVFEAVSGPPPADLCHALRWYNHIKSYEKEKASLPGVKKALGKYGPADVEDTTGSGAT

SEQ ID NO: 248 - protein, 101 aa, Artificial Sequence
  Description of Artificial Sequence: Synthetic polypeptide
SLNITSLGLRSLKEISDGDVIISGNKNLCYANTINWKKLFGTSGQKTKIIRNRGENSCKATGQVCHALCSPEGCWGPEPRDCVSCRNVSRGRECVDKCNLL

SEQ ID NO: 249 - protein, 101 aa, Artificial Sequence
  Description of Artificial Sequence: Synthetic polypeptide
IPVAIKELREATSPKANKEILDEAYVMASVDNPHVCRLLGICLTSTVQLIMQLMPFGCLLDYVREHKDNIGSQYLLNWCVQIAKGMNYLEDRRLVHRDLAA

SEQ ID NO: 250 - protein, 101 aa, Artificial Sequence
  Description of Artificial Sequence: Synthetic polypeptide
ERCEVVMGNLEIVLTGHNADLSFLQWIREVTGYVLVAMNEFSTLPLPNLRMVRGTQVYDGKFAIFVMLNYNTNSSHALRQLRLTQLTEILSGGVYIEKNDK

SEQ ID NO: 251 - protein, 101 aa, Artificial Sequence
  Description of Artificial Sequence: Synthetic polypeptide
HLMAKAGLTLQQQHQRLAQLLLILSHIRHMSNKGMEHLYSMKCKNVVPLYGLLLEMLDAHRLHAPTSRGGASVEETDQSHLATAGSTSSHSLQKYYITGEA

SEQ ID NO: 252 - protein, 101 aa, Artificial Sequence
  Description of Artificial Sequence: Synthetic polypeptide
NQGKCVEGMVEIFDMLLATSSRFRMMNLQGEEFVCLKSIILLNSGVYTFLPSTLKSLEEKDHIHRVLDKITDTLIHLMAKAGLTLQQQHQRLAQLLLILSH

SEQ ID NO: 253 - protein, 101 aa, Artificial Sequence
  Description of Artificial Sequence: Synthetic polypeptide
IHLMAKAGLTLQQQHQRLAQLLLILSHIRHMSNKGMEHLYSMKCKNVVPLCDLLLEMLDAHRLHAPTSRGGASVEETDQSHLATAGSTSSHSLQKYYITGE

SEQ ID NO: 254 - protein, 101 aa, Artificial Sequence
  Description of Artificial Sequence: Synthetic polypeptide
IHLMAKAGLTLQQQHQRLAQLLLILSHIRHMSNKGMEHLYSMKCKNVVPLNDLLLEMLDAHRLHAPTSRGGASVEETDQSHLATAGSTSSHSLQKYYITGE

SEQ ID NO: 255 - protein, 101 aa, Artificial Sequence
  Description of Artificial Sequence: Synthetic polypeptide
IHLMAKAGLTLQQQHQRLAQLLLILSHIRHMSNKGMEHLYSMKCKNVVPLSDLLLEMLDAHRLHAPTSRGGASVEETDQSHLATAGSTSSHSLQKYYITGE

SEQ ID NO: 256 - protein, 101 aa, Artificial Sequence
  Description of Artificial Sequence: Synthetic polypeptide
HRIGGIKLRHQQWSLVMESVVPSDRGNYTCVVENKFGSIRQTYTLDVLERCPHRPILQAGLPANQTAVLGSDVEFHCKVYSDAQPHIQWLKHVEVNGSKVG

SEQ ID NO: 257 - protein, 101 aa, Artificial Sequence
  Description of Artificial Sequence: Synthetic polypeptide
AVKLSDSRIALKSGYGKYLGINSDELVGHSDAIGPREQWEPVFQNGKMALSASNSCFIRCNEAGDIEAKSKTAGEEEMIKIRSCAEKETKKKDDIPEEDKG

SEQ ID NO: 258 - protein, 101 aa, Artificial Sequence
  Description of Artificial Sequence: Synthetic polypeptide
GSGAFGTVYKGIWIPDGENVKIPVAIKVLRENTSPKANKEILDEAYVMAGLGSPYVSRLLGICLTSTVQLVTQLMPYGCLLDHVRENRGRLGSQDLLNWCM

SEQ ID NO: 259 - protein, 101 aa, Artificial Sequence
  Description of Artificial Sequence: Synthetic polypeptide
RVEEFKLKQMWKSPNGTIRNILGGTVFREAIICKNIPRLVSGWVKPIIIGHHAYGDQYRATDFVVPGPGKVEITYTPSDGTQKVTYLVHNFEEGGGVAMGM

SEQ ID NO: 260 - protein, 101 aa, Artificial Sequence
  Description of Artificial Sequence: Synthetic polypeptide
RVEEFKLKQMWKSPNGTIRNILGGTVFREAIICKNIPRLVSGWVKPIIIGCHAYGDQYRATDFVVPGPGKVEITYTPSDGTQKVTYLVHNFEEGGGVAMGM

SEQ ID NO: 261 - protein, 101 aa, Artificial Sequence
  Description of Artificial Sequence: Synthetic polypeptide
RVEEFKLKQMWKSPNGTIRNILGGTVFREAIICKNIPRLVSGWVKPIIIGGHAYGDQYRATDFVVPGPGKVEITYTPSDGTQKVTYLVHNFEEGGGVAMGM

SEQ ID NO: 262 - protein, 101 aa, Artificial Sequence
  Description of Artificial Sequence: Synthetic polypeptide
RVEEFKLKQMWKSPNGTIRNILGGTVFREAIICKNIPRLVSGWVKPIIIGSHAYGDQYRATDFVVPGPGKVEITYTPSDGTQKVTYLVHNFEEGGGVAMGM

SEQ ID NO: 263 - protein, 101 aa, Artificial Sequence
  Description of Artificial Sequence: Synthetic polypeptide
VAVKMLKPSAHLTEREALMSELKVLSYLGNHMNIVNLLGACTIGGPTLVIIEYCCYGDLLNFLRRKRDSFICSKQEDHAEAALYKNLLHSKESSCSDSTNE

SEQ ID NO: 264 - protein, 101 aa, Artificial Sequence
  Description of Artificial Sequence: Synthetic polypeptide
VEATAYGLIKSDAAMTVAVKMLKPSAHLTEREALMSELKVLSYLGNHMNIANLLGACTIGGPTLVITEYCCYGDLLNFLRRKRDSFICSKQEDHAEAALYK

SEQ ID NO: 265 - protein, 101 aa, Artificial Sequence
  Description of Artificial Sequence: Synthetic polypeptide
ISELGAGNGGVVFKVSHKPSGLVMARKLIHLEIKPAIRNQIIRELQVLHESNSPYIVGFYGAFYSDGEISICMEHMDGGSLDQVLKKAGRIPEQILGKVSI

SEQ ID NO: 266 - protein, 101 aa, Artificial Sequence
  Description of Artificial Sequence: Synthetic polypeptide
LGAGNGGVVFKVSHKPSGLVMARKLIHLEIKPAIRNQIIRELQVLHECNSLYIVGFYGAFYSDGEISICMEHMDGGSLDQVLKKAGRIPEQILGKVSIAVI

SEQ ID NO: 267 - protein, 89 aa, Artificial Sequence
  Description of Artificial Sequence: Synthetic polypeptide
MPLNVSFTNRNYDLDYDSVQPYFYCDEEENFYQQQQQSDLQPPAPSEDIWKKFELLPTPPLSPSRRSGLCSPSYVAVTPFSLRGDNDGG

SEQ ID NO: 268 - protein, 101 aa, Artificial Sequence
  Description of Artificial Sequence: Synthetic polypeptide
FTNRNYDLDYDSVQPYFYCDEEENFYQQQQQSELQPPAPSEDIWKKFELLSTPPLSPSRRSGLCSPSYVAVTPFSLRGDNDGGGGSFSTADQLEMVTELLG

SEQ ID NO: 269 - protein, 101 aa, Artificial Sequence
  Description of Artificial Sequence: Synthetic polypeptide
TNRNYDLDYDSVQPYFYCDEEENFYQQQQQSELQPPAPSEDIWKKFELLPIPPLSPSRRSGLCSPSYVAVTPFSLRGDNDGGGGSFSTADQLEMVTELLGG

SEQ ID NO: 270 - protein, 101 aa, Artificial Sequence
  Description of Artificial Sequence: Synthetic polypeptide
VAVKMLKPTARSSEKQALMSELKIMTHLGPHLNIVNLLGACTKSGPIYIIIEYCFYGDLVNYLHKNRDSFLSHHPEKPKKELDIFGLNPADESTRSYVILS

SEQ ID NO: 271 - protein, 101 aa, Artificial Sequence
  Description of Artificial Sequence: Synthetic polypeptide
IEEHANWSVSREAGFSYSHAGLSNRLARDNELRENDKEQLKAISTRDPLSKITEQEKDFLWSHRHYCVTIPEILPKLLLSVKWNSRDEVAQMYCLVKDWPP

SEQ ID NO: 272 - protein, 101 aa, Artificial Sequence
  Description of Artificial Sequence: Synthetic polypeptide
HANWSVSREAGFSYSHAGLSNRLARDNELRENDKEQLKAISTRDPLSEITKQEKDFLWSHRHYCVTIPEILPKLLLSVKWNSRDEVAQMYCLVKDWPPIKP

SEQ ID NO: 273 - protein, 72 aa, Artificial Sequence
  Description of Artificial Sequence: Synthetic polypeptide
LFINLFSMMLGSGMPELQSFDDIAYIRKTLALDKTEQEALEYFMKQMNDARHGGWTTKMDWIFHTIKQHALN

SEQ ID NO: 274 - protein, 101 aa, Artificial Sequence
  Description of Artificial Sequence: Synthetic polypeptide
QRGGVITDEEETSKKIADQLDNIVDMREYDVPYHIRLSIDIETTKLPLKFRDAETDQIMMISYMIDGQGYLITNREIVSEDIEDFEFTPKPEYEGPFCVFN

SEQ ID NO: 275 - protein, 101 aa, Artificial Sequence
  Description of Artificial Sequence: Synthetic polypeptide
KFNCRVAQYPFEDHNPPQLELIKPFCEDLDQWLSEDDNHVAAIHCKAGKGQTGVMICAYLLHRGKFLKAQEALDFYGEVRTRDKKGVTIPSQRRYVYYYSY

SEQ ID NO: 276 - protein, 79 aa, Artificial Sequence
  Description of Artificial Sequence: Synthetic polypeptide
MQAIKCVVVGDGAVGKTCLLISYTTNAFSGEYIPTVFDNYSANVMVDGKPVNLGLWDTAGQEDYDRLRPLSYPQTVGET

SEQ ID NO: 277 - protein, 101 aa, Artificial Sequence
  Description of Artificial Sequence: Synthetic polypeptide
IRVEGNLRVEYLDDRNTFRHSVVVPYEPPEVGSDCTTIHYNYMCNSSCMGSMNRRPILTIITLEDSSGNLLGRNSFEVRVCACPGRDRRTEEENLRKKGEP

SEQ ID NO: 278 - protein, 101 aa, Artificial Sequence
  Description of Artificial Sequence: Synthetic polypeptide
TYSPALNKMFCQLAKTCPVQLWVDSTPPPGTRVRAMAIYKQSQHMTEVVRHCPHHERCSDSDGLAPPQHLIRVEGNLRVEYLDDRNTFRHSVVVPYEPPEV

SEQ ID NO: 279 - protein, 101 aa, Artificial Sequence
  Description of Artificial Sequence: Synthetic polypeptide
EGNLRVEYLDDRNTFRHSVVVPYEPPEVGSDCTTIHYNYMCNSSCMGGMNQRPILTIITLEDSSGNLLGRNSFEVRVCACPGRDRRTEEENLRKKGEPHHE

SEQ ID NO: 280 - protein, 101 aa, Artificial Sequence
  Description of Artificial Sequence: Synthetic polypeptide
EGNLRVEYLDDRNTFRHSVVVPYEPPEVGSDCTTIHYNYMCNSSCMGGMNWRPILTIITLEDSSGNLLGRNSFEVRVCACPGRDRRTEEENLRKKGEPHHE

SEQ ID NO: 281 - protein, 101 aa, Artificial Sequence
  Description of Artificial Sequence: Synthetic polypeptide
PEVGSDCTTIHYNYMCNSSCMGGMNRRPILTIITLEDSSGNLLGRNSFEVCVCACPGRDRRTEEENLRKKGEPHHELPPGSTKRALPNNTSSSPQPKKKPL

SEQ ID NO: 282 - protein, 53 aa, Artificial Sequence
  Description of Artificial Sequence: Synthetic polypeptide
GVEPCYGDKDKRRHCFATWKNISGSIEIVKQGCWLDDINCYDRTDCVEKKRQP

SEQ ID NO: 283 - protein, 103 aa, Artificial Sequence
  Description of Artificial Sequence: Synthetic polypeptide
GVEPCYGDKDKRRHCFATWKNISGSIEIVKQGCWLDDINCYDRTDCVEKKTALKYIFVAVRAICVMKSFLIFRRWKSHSPLQIQLHLSHPITTSCSIPWCHLC

SEQ ID NO: 284 - protein, 118 aa, Artificial Sequence
  Description of Artificial Sequence: Synthetic polypeptide
TAEAVNVAIAAPPSEGEANAELCRYLSKVLELRKSDVVLDKVGLALFFFFFETKSCSVAQAGVQWRSLGSLQPPPPGFKLFSCLSFLSSWDYRRMPPCLANFCIFNRDGVSPCWSGWS

SEQ ID NO: 285 - protein, 71 aa, Artificial Sequence
  Description of Artificial Sequence: Synthetic polypeptide
LSVIIFFFVYIWHWALPLILNNHHICLMSSIILDCNSVRQSIMSVCFFFFSVIFSTRCLTDSRYPNICWFK

SEQ ID NO: 286 - protein, 60 aa, Artificial Sequence
  Description of Artificial Sequence: Synthetic polypeptide
LSVIIFFFVYIWHWALPLILNNHHICLMSSIILDCNSVRQSIMSVCFFFFCYILNTMFDR

SEQ ID NO: 287 - protein, 106 aa, Artificial Sequence
  Description of Artificial Sequence: Synthetic polypeptide
VLVLSCDLITDVALHEVVDLFRAYDASLAMLMRKGQDSIEPVPGQKGKKKQWSSVTSLEWTAQERGCSSWLMKQTWMKSWSLRDPSYRSILEYVSTRVLWMPTSTV

SEQ ID NO: 288 - protein, 112 aa, Artificial Sequence
  Description of Artificial Sequence: Synthetic polypeptide
SIQVMRAQMNQIQSVEGQPLARRPRATGRTKRCQPRDVTKKTCNSNDGKKREWEKRKQILGGGGKYKEYFLKRILIRKAMTVLAGDKKGLGRFMRCVQSETKAVSLQLPLGR

SEQ ID NO: 289 - protein, 57 aa, Artificial Sequence
  Description of Artificial Sequence: Synthetic polypeptide
LDFLGEFATDIRTHGVHMVLNHQGRPSGDAFIQMKSADRAFMAAQKCHKKKHEGQIC

SEQ ID NO: 290 - protein, 51 aa, Artificial Sequence
  Description of Artificial Sequence: Synthetic polypeptide
LDFLGEFATDIRTHGVHMVLNHQGRPSGDAFIQMKSADRAFMAAQKCHKKT

SEQ ID NO: 291 - protein, 75 aa, Artificial Sequence
  Description of Artificial Sequence: Synthetic polypeptide
GALCKDGRFRSDIGEFEWKLKEGHKKIYGKQSMVDEVSGKVLEMDISKKKHYNRKISIKKLNRMKVPLMKLITRV

SEQ ID NO: 292 - protein, 58 aa, Artificial Sequence
  Description of Artificial Sequence: Synthetic polypeptide
RERAQLLEEQEKTLTSKLQEQARVLKERCQGESTQLQNEIQKLQKTLKKKPRDICRIS

SEQ ID NO: 293 - protein, 53 aa, Artificial Sequence
  Description of Artificial Sequence: Synthetic polypeptide
VNTLKEGKRLPCPPNCPDEVYQLMRKCWEFQPSNRTSFQNLIEGFEALLKTSN

SEQ ID NO: 294 - protein, 65 aa, Artificial Sequence
  Description of Artificial Sequence: Synthetic polypeptide
CRPVTPSCKELADLMTRCMNYDPNQRPFFRAIMRDINKLEEQNPDIVSEKNQQLKWTPHILKSAS

SEQ ID NO: 295 - protein, 69 aa, Artificial Sequence
  Description of Artificial Sequence: Synthetic polypeptide
DDHDVLSFLTFQLTEPGKEPPTPDKEISEKEKEKYQEEFEHFQQELDKKKRGIPEGPPRPPRAACGGNI

SEQ ID NO: 296 - protein, 71 aa, Artificial Sequence
  Description of Artificial Sequence: Synthetic polypeptide
DDHDVLSFLTFQLTEPGKEPPTPDKEISEKEKEKYQEEFEHFQQELDKKKRNSRRATPTSKGSLRRKYLRV

SEQ ID NO: 297 - protein, 68 aa, Artificial Sequence
  Description of Artificial Sequence: Synthetic polypeptide
TKSTLIGEDVNPLIKLDDAVNVDEIMTDTSTSYLLCISENKENVRDKKKGQHFYWHCGSAACHRRGCV

SEQ ID NO: 298 - protein, 81 aa, Artificial Sequence
  Description of Artificial Sequence: Synthetic polypeptide
LYTKSTLIGEDVNPLIKLDDAVNVDEIMTDTSTSYLLCISENKENVRDKKRATFLLALWECSLPQARLCLIVSRTLLLVQS

SEQ ID NO: 299 - protein, 58 aa, Artificial Sequence
  Description of Artificial Sequence: Synthetic polypeptide
LPPPKLTDPRLLYIGFLGYCSGLIDNLIRRRPIATAGLHRQLLYITAFFFCWILSCKT

SEQ ID NO: 300 - protein, 56 aa, Artificial Sequence
  Description of Artificial Sequence: Synthetic polypeptide
SLPPPKLTDPRLLYIGFLGYCSGLIDNLIRRRPIATAGLHRQLLYITAFFLLDIIL

SEQ ID NO: 301 - protein, 112 aa, Artificial Sequence
  Description of Artificial Sequence: Synthetic polypeptide
NQSGGAGEDCQIFSTPGHPKMIYSSSNLKTPSKLCSGSKSHDVQEVLKKKTGSNEVTTRYEEKKTGSVRKANRMPKDVNIQVRKKQKHETRRKSKYNEDFERAWREDLTIKR

SEQ ID NO: 302 - protein, 23 aa, Artificial Sequence
  Description of Artificial Sequence: Synthetic peptide
MAPVKKLVVKGGKKKEASSEVHS

SEQ ID NO: 303 - protein, 18 aa, Artificial Sequence
  Description of Artificial Sequence: Synthetic peptide
MAPVKKLVVKGGKKRSKF

SEQ ID NO: 304 - protein, 51 aa, Artificial Sequence
  Description of Artificial Sequence: Synthetic polypeptide
MPSHQGAEQQQQQHHVFISQVVTEKEFLSRSDQLQQAVQSQGFINYCQKKN

SEQ ID NO: 305 - protein, 65 aa, Artificial Sequence
  Description of Artificial Sequence: Synthetic polypeptide
MPSHQGAEQQQQQHHVFISQVVTEKEFLSRSDQLQQAVQSQGFINYCQKKLMLLRLNLRKMCGPF

SEQ ID NO: 306 - protein, 79 aa, Artificial Sequence
  Description of Artificial Sequence: Synthetic polypeptide
AEVFEKEQSICAAEEQPAEDGQGETNKNRTKGGWQQKSKGPKKTAKSKKKETFKKKTYTCAITTVKATETKAGKWSRWE

SEQ ID NO: 307 - protein, 53 aa, Artificial Sequence
  Description of Artificial Sequence: Synthetic polypeptide
MAEVFEKEQSICAAEEQPAEDGQGETNKNRTKGGWQQKSKGPKKTAKSKKRNL

SEQ ID NO: 308 - protein, 71 aa, Artificial Sequence
  Description of Artificial Sequence: Synthetic polypeptide
NIMEIRQLPSSHALEAKLSRMSYPVKEQESILKTVGKLTATQVAKISFFFALCGFWQICHIKKHFQTHKLL

SEQ ID NO: 309 - protein, 68 aa, Artificial Sequence
  Description of Artificial Sequence: Synthetic polypeptide
YEKKKYYDKNAIAITNISSSDAPLQPLVSSPSLQAAVDKNKLEKEKEKKKGREKERKGARKAGKTTYS

SEQ ID NO: 310 - protein, 97 aa, Artificial Sequence
  Description of Artificial Sequence: Synthetic polypeptide
KYEKKKYYDKNAIAITNISSSDAPLQPLVSSPSLQAAVDKNKLEKEKEKKRKRKREKRSQKSRQNHLQLKSCRRKISNWSLKKVPALKKLRSPLWIF

SEQ ID NO: 311 - protein, 65 aa, Artificial Sequence
  Description of Artificial Sequence: Synthetic polypeptide
IYQDAYRAEWQVYKEEISRFKEQLTPSQIMSLEKEIMDKHLKRKAMTKKKRVNTAWKTKKTSFSL

SEQ ID NO: 312 - protein, 51 aa, Artificial Sequence
  Description of Artificial Sequence: Synthetic polypeptide
IYQDAYRAEWQVYKEEISRFKEQLTPSQIMSLEKEIMDKHLKRKAMTKKKS

SEQ ID NO: 313 - protein, 52 aa, Artificial Sequence
  Description of Artificial Sequence: Synthetic polypeptide
KPQEVCVAVWRKNDENITLETVCHDPKLPYHDFILEDAASPKCIMKEKKKAW

SEQ ID NO: 314 - protein, 84 aa, Artificial Sequence
  Description of Artificial Sequence: Synthetic polypeptide
EKPQEVCVAVWRKNDENITLETVCHDPKLPYHDFILEDAASPKCIMKEKKSLVRLSSCVPVALMSAMTTSSSQKNITPAILTCC

SEQ ID NO: 315 - protein, 74 aa, Artificial Sequence
  Description of Artificial Sequence: Synthetic polypeptide
VPSKYQFLCSDHFTPDSLDIRWGIRYLKQTAVPTIFSLPEDNQGKDPSKKNPRRKTWKMRKKYAQKPSQKNHLY

SEQ ID NO: 316 - protein, 88 aa, Artificial Sequence
  Description of Artificial Sequence: Synthetic polypeptide
GTTEEMKYVLGQLVGLNSPNSILKAAKTLYEHYSGGESHNSSSSKTFEKKGEKNDLQLFVMSDTTYKIYWTVILLNPCGNLHLKTTSL

SEQ ID NO: 317 - protein, 55 aa, Artificial Sequence
  Description of Artificial Sequence: Synthetic polypeptide
QQLIRETLISWLQAQMLNPQPEKTFIRNKAAQVFALLFVTEYLTKWPKFFLTFSQ

SEQ ID NO: 318 - protein, 93 aa, Artificial Sequence
  Description of Artificial Sequence: Synthetic polypeptide
AKFQQCHSTLEPNPADCRVLVYLQNQPGTKLLNFLQERNLPPKVVLRHPKVHLNTMFRRPHSCLADVLLSVHLIVLRVVRLPAPFRVNHAVEW

SEQ ID NO: 319 - protein, 53 aa, Artificial Sequence
  Description of Artificial Sequence: Synthetic polypeptide
APVIFQIALDKPCHQAEVKHLHHLLKQLKPSEKYLKIKHLLLKRERVDLSKLQ

SEQ ID NO: 320 - protein, 33 aa, Artificial Sequence
  Description of Artificial Sequence: Synthetic polypeptide
MLQFRGSRFFQMLILYYILPRKVLQMDFLVHPA

SEQ ID NO: 321 - protein, 179 aa, Artificial Sequence
  Description of Artificial Sequence: Synthetic polypeptide
ALGPHSRISCLPTQTRGCILLAATPRSSSSSSSNDMIPMAISSPPKAPLLAAPSPASRLQCINSNSRITSGQWMAHMALLPSGTKGRCTACHTALGRGSLSSSSCPQPSPSLPASNKLPSLPLSKMYTTSMAMPILPLPQLLLSADQQAAPRTNFHSSLAETVSLHPLAPMPSKTCHHK

SEQ ID NO: 322 - protein, 79 aa, Artificial Sequence
  Description of Artificial Sequence: Synthetic polypeptide
AHQGFPAAKESRVIQLSLLSLLIPPLTCLASEALPRPLLALPPVLLSLAQDHSRLLQCQATRCHLGHPVASRTASCILP

SEQ ID NO: 323 - protein, 222 aa, Artificial Sequence
  Description of Artificial Sequence: Synthetic polypeptide
PILAATGTSVRTAARTWVPRAAIRVPDPAAVPDDHAGPGAECHGRPLLYTADSSLWTTRPQRVWSTGPDSILQPAKSSPSAAAATLLPATTVPDPSCPTFVSAAATVSTTTAPVLSASILPAAIPASTSAVPGSIPLPAVDDTAAPPEPAPLLTATGSVSLPAAATSAASTLDALPAGCVSSAPVSAVPANCLFPAALPSTAGAISRFIWVSGILSPLNDLQ

SEQ ID NO: 324 - protein, 185 aa, Artificial Sequence
  Description of Artificial Sequence: Synthetic polypeptide
PCRAGRRVPWAASLIHSRFLLMDNKAPAGMVNRARLHITTSKVLTLSSSSHPTPSNHRPRPLMPNLRISSSHSLNHHSSSPLSLHTPSSHPSLHISSPRLHTPPSSRRHSSTPRASPPTHSHRLSLLTSSSNLSSQHPRRSPSRLRILSPSLSSPSKLPIPSSASLHRRSYLKIHLGLRHPQPPQ

SEQ ID NO: 325 - protein, 58 aa, Artificial Sequence
  Description of Artificial Sequence: Synthetic polypeptide
RTNPTVRMRPHCVPFWTGRILLPSAASVCPIPFEACHLCQAMTLRCPNTQGCCSSWAS

SEQ ID NO: 326 - protein, 90 aa, Artificial Sequence
  Description of Artificial Sequence: Synthetic polypeptide
TNQALPKIEVICRGTPRCPSTVPPSPAQPYLRVSLPEDRYTQAWAPTSRTPWGAMVPRGVSMAHKVATPGSQTIMPCPMPTTPVQAWLEA

SEQ ID NO: 327 - protein, 41 aa, Artificial Sequence
  Description of Artificial Sequence: Synthetic polypeptide
RMERELKKWSIQTCLSARTGLSISCTTLNSPPLKKMSMPAV

SEQ ID NO: 328 - protein, 35 aa, Artificial Sequence
  Description of Artificial Sequence: Synthetic polypeptide
LCSRYSLFLAWRLSSVLQRFRFTHVIQQRMESQIS

SEQ ID NO: 329 - protein, 39 aa, Artificial Sequence
  Description of Artificial Sequence: Synthetic polypeptide
RSACVTVKGPLASVGRHSLSKQDCKFLPFWGFLEEFLLC

SEQ ID NO: 330 - protein, 97 aa, Artificial Sequence
  Description of Artificial Sequence: Synthetic polypeptide
IQWGTTTAPRPIRPPFLESKQNCSHFPTPLLASEDRRETGLFLPSAAQKMKKAHFLKTWFRSNPTKTKKARFSTASLAKELTHPLLVSLLLKEKQDG

SEQ ID NO: 331 - protein, 73 aa, Artificial Sequence
  Description of Artificial Sequence: Synthetic polypeptide
PTDPFLGLRLGLHLQKVFHQSHAEYSGAPPPPPAPSGLRFWNPSRIAHISQLLSWPQKTEERLGYSSHQLPRK

SEQ ID NO: 332 - protein, 45 aa, Artificial Sequence
  Description of Artificial Sequence: Synthetic polypeptide
FCCSCCFFGGERWSKSPYCPQRMTPGTTFITMMKKEAEKRTRTLT

SEQ ID NO: 333 - protein, 95 aa, Artificial Sequence
  Description of Artificial Sequence: Synthetic polypeptide
WRRNCKAPVSLRKSVQTPARSSPARPDRTRRLPSLGVPGQPWALGAAASRRCCCCCRSPLGSARSRSPATLALTPRATRSRCPGATWREAASWAE

SEQ ID NO: 334 - protein, 113 aa, Artificial Sequence
  Description of Artificial Sequence: Synthetic polypeptide
PGRPLQTHVLPEPHLALQPLQPHADHAHADAPAIQPVLWTTPPLQHGHRHGLEPCSMLTGPPARVPAVPFDLHFCRSSIMKPKRDGYMFLKAESKIMFATLQRSSLWCLCSNH

SEQ ID NO: 335 - protein, 57 aa, Artificial Sequence
  Description of Artificial Sequence: Synthetic polypeptide
PRPRRCTRHPACPLDHTTPPAWSPPWVRALLDAHRAPSESPCSPFRLAFLQEQYHEA

SEQ ID NO: 336 - protein, 494 aa, Artificial Sequence
  Description of Artificial Sequence: Synthetic polypeptide
TRRCHCCPHLRSHPCPHHLRNHPRPHHLRHHACHHHLRNCPHPHFLRHCTCPGRWRNRPSLRRLRSLLCLPHLNHHLFLHWRSRPCLHRKSHPHLLHLRRLYPHHLKHRPCPHHLKNLLCPRHLRNCPLPRHLKHLACLHHLRSHPCPLHLKSHPCLHHRRHLVCSHHLKSLLCPLHLRSLPFPHHLRHHACPHHLRTRLCPHHLKNHLCPPHLRYRAYPPCLWCHACLHRLRNLPCPHRLRSLPRPLHLRLHASPHHLRTPPHPHHLRTHLLPHHRRTRSCPCRWRSHPCCHYLRSRNSAPGPRGRTCHPGLRSRTCPPGLRSHTYLRRLRSHTCPPSLRSHAYALCLRSHTCPPRLRDHICPLSLRNCTCPPRLRSRTCLLCLRSHACPPNLRNHTCPPSLRSHACPPGLRNRICPLSLRSHPCPLGLKSPLRSQANALHLRSCPCSLPLGNHPYLPCLESQPCLSLGNHLCPLCPRSCRCPHLGSHPCRLS

SEQ ID NO: 337 - protein, 53 aa, Artificial Sequence
  Description of Artificial Sequence: Synthetic polypeptide
SWKGTNWCNDMCIFITSGQIFKGTRGPRFLWGSKDQRQKGSNYSQSEALCVLL

SEQ ID NO: 338 - protein, 9 aa, Artificial Sequence
  Description of Artificial Sequence: Synthetic peptide
KRTKCFTFG

SEQ ID NO: 339 - protein, 27 aa, Artificial Sequence
  Description of Artificial Sequence: Synthetic peptide
PIFIQTLLLWDFLQKDLKAYTGTILMM

SEQ ID NO: 340 - protein, 22 aa, Artificial Sequence
  Description of Artificial Sequence: Synthetic peptide
QKMILTKQIKTKPTDTFLQILR

SEQ ID NO: 341 - protein, 43 aa, Artificial Sequence
  Description of Artificial Sequence: Synthetic polypeptide
GFWIQSIKTITRYTIFVLKDIMTPPNLIAELHNILLKTITHHS

SEQ ID NO: 342 - protein, 40 aa, Artificial Sequence
  Description of Artificial Sequence: Synthetic polypeptide
NYSNVQWRNLQSSVCGLPAKGEDIFLQFRTHTTGRQVHVL

SEQ ID NO: 343 - protein, 44 aa, Artificial Sequence
  Description of Artificial Sequence: Synthetic polypeptide
YQSRVLPQTEQDAKKGQNVSLLGKYILHTRTRGNLRKSRKWKSM

SEQ ID NO: 344 - protein, 85 aa, Artificial Sequence
  Description of Artificial Sequence: Synthetic polypeptide
SSQNARGCSPRGPCTSSSYTGGPCTSPLLAPVIFCPFPENLPGQLRFPSGLLAFWDSQVCDLHVLPCPQQDVLPTGQDLPCAAVG

SEQ ID NO: 345 - protein, 72 aa, Artificial Sequence
  Description of Artificial Sequence: Synthetic polypeptide
GAAPTMSAAQIAMVWPLLSILSEWKEICVWSIWMTETLFDIVWWCPMSRLRLALTVPPSTTTTCVTVPAWAA

SEQ ID NO: 346 - protein, 97 aa, Artificial Sequence
  Description of Artificial Sequence: Synthetic polypeptide
TGGPSSPSSHWKTPVVIYWDGTALRCVFVPVLGETGAQRKRISARKGSLTTSCPQGALSEHCPTTPAPLPSQRRNHWMENISPFRSVGVSASRCSES

SEQ ID NO: 347 - protein, 31 aa, Artificial Sequence
  Description of Artificial Sequence: Synthetic polypeptide
FHTPARHPRPRHGHLQAVTAHDGGCEALPPP

SEQ ID NO: 348 - protein, 78 aa, Artificial Sequence
  Description of Artificial Sequence: Synthetic polypeptide
CCPRTILNNGSLKTQVQMKLPECQRLLPPWPLHQQLLHRRPLHQPPPGPCHLLSLPRKPTRAATVSVWASCILGQPSL

SEQ ID NO: 349 - protein, 28 aa, Artificial Sequence
  Description of Artificial Sequence: Synthetic peptide
VRKHFQTYGNYFLKTTFCPPCRPKQWMI

SEQ ID NO: 350 - protein, 46 aa, Artificial Sequence
  Description of Artificial Sequence: Synthetic polypeptide
LARTPLPSTRCFANWPRPALCSCGLIPHPRPAPASAPWPSTSSHST

SEQ ID NO: 351 - protein, 81 aa, Artificial Sequence
  Description of Artificial Sequence: Synthetic polypeptide
ELQETGHRQVALRRSGRPPKCAERPGAADTGAHCTSTDGRLKISVETYTVSSQLLMVLMSLDLDTGLVPSLVSKCLILRVK

SEQ ID NO: 352 - protein, 10 aa, Artificial Sequence
  Description of Artificial Sequence: Synthetic peptide
KSDASRLSGA

SEQ ID NO: 353 - protein, 29 aa, Artificial Sequence
  Description of Artificial Sequence: Synthetic peptide
RTAYFCQYHTASVYSERAMPPGCPEPSQA

SEQ ID NO: 354 - protein, 91 aa, Artificial Sequence
  Description of Artificial Sequence: Synthetic polypeptide
TRASPPRSSSAIAVRASCCPYGSTSTASRSPTQRCRLARAAASTATEVTFGSSEMQGHTMGFWLTKLNYLCHLSMLTDSLFLPISHCQCIL

SEQ ID NO: 355 - protein, 31 aa, Artificial Sequence
  Description of Artificial Sequence: Synthetic polypeptide
SSLRITGDWTSSGRSTKIWKTTQMCRKTWSG

SEQ ID NO: 356 - protein, 104 aa, Artificial Sequence
  Description of Artificial Sequence: Synthetic polypeptide
RRRRGGVGRRGVRPGRVRPGGTGRRGGDGGRAAAARAALGELARALPGHLLQSQSARRAARMAQLRRRAAALPNAAAWHGPPHPQLPRSPLALQRCRDTRWASG

SEQ ID NO: 357 - protein, 66 aa, Artificial Sequence
  Description of Artificial Sequence: Synthetic polypeptide
SCKVFFKRAAEGKQKYLCASRNDCTIDKFRRKNCPSCRLRKCYEAGMTLGEKFRVGNCKHLKMTRP

SEQ ID NO: 358 - protein, 49 aa, Artificial Sequence
  Description of Artificial Sequence: Synthetic polypeptide
MAGAPPPASLPPCSLISDCCASNQRDSVGVGPSEPGNNIKICNESASRK

SEQ ID NO: 359 - protein, 61 aa, Artificial Sequence
  Description of Artificial Sequence: Synthetic polypeptide
HGWRPFLPVRARSRWNRRLDVTVANGRSWKYGWSLLRVPQVNGIQVLNVSLKSSSNVISYE

SEQ ID NO: 360 - protein, 65 aa, Artificial Sequence
  Description of Artificial Sequence: Synthetic polypeptide
RLKEVFQTKIQEFRKACYTLTGYQIDITTENQYRLTSLYAEHPGDCLIFKLRVPGSSVLVTVPGL

SEQ ID NO: 361 - protein, 107 aa, Artificial Sequence
  Description of Artificial Sequence: Synthetic polypeptide
AEVLKVIRQSAGQKTTCGQGLEGPWERPPPLDESERDGGSEDQVEDPALSALLLRPRPPRPEVGAHQDEQAAQGADPRLGAQPACRGLPGLLTVPQPEPLLAPPSAA

SEQ ID NO: 362 - protein, 100 aa, Artificial Sequence
  Description of Artificial Sequence: Synthetic polypeptide
ERAEWRENIREQQKKCFRSFSLTSVELQMLTNSCVKLQTVHSIPLTINKEEALQRPVASDFEPQGLSEAARWNSKENLLAGPSENDPNLFVALYDFVASG

SEQ ID NO: 363 - protein, 101 aa, Artificial Sequence
  Description of Artificial Sequence: Synthetic polypeptide
ELQMLTNSCVKLQTVHSIPLTINKEDDESPGLYGFLNVIVHSATGFKQSSKALQRPVASDFEPQGLSEAARWNSKENLLAGPSENDPNLFVALYDFVASGD

SEQ ID NO: 364 - protein, 101 aa, Artificial Sequence
  Description of Artificial Sequence: Synthetic polypeptide
ISNSWDAHLGLGACGEAEGLGVQGAEEEEEEEEEEEEEGAGVPACPPKGPELFPLIFPAEPAQASGPYVEIIEQPKQRGMRFRYKCEGRSAGSIPGERSTD

SEQ ID NO: 365 - protein, 100 aa, Artificial Sequence
  Description of Artificial Sequence: Synthetic polypeptide
LQRLDGMGCLEFDEERAQQEDALAQQAFEEARRRTREFEDRDRSHREEMEVHELEKSKRALETQMEEMKTQLEELEDELQATEDAKLRLEVNMQALKGQF

SEQ ID NO: 366 - protein, 100 aa, Artificial Sequence
  Description of Artificial Sequence: Synthetic polypeptide
KGSFPENLRHLKNTMETIDWKVFESWMHHWLLFEMSRHSLEQKPTDAPPKAGVPNKPGIPKLLEGSKNSIQWEKAEDNGCRITYYILEIRKSTSNNLQNQ

SEQ ID NO: 367 - protein, 80 aa, Artificial Sequence
  Description of Artificial Sequence: Synthetic polypeptide
MRPSGTAGAALLALLAALCPASRALEEKKGNYVVTDHGSCVRACGADSYEMEEDGVRKCKKCEGPCRKVCNGIGIGEFKD

SEQ ID NO: 368 - protein, 100 aa, Artificial Sequence
  Description of Artificial Sequence: Synthetic polypeptide
LPQPPICTIDVYMIMVKCWMIDADSRPKFRELIIEFSKMARDPQRYLVIQLQDKFEHLKMIQQEEIRKLEEEKKQLEGEIIDFYKMKAASEALQTQLSTD

SEQ ID NO: 369 - protein, 101 aa, Artificial Sequence
  Description of Artificial Sequence: Synthetic polypeptide
SWENSDDSRNKLSKIPSTPKLIPKVTKTADKHKDVIINQAKMSTREKNSQVYRRKHQELQAMQMELQSPEYKLSKLRTSTIMTDYNPNYCFAGKTSSISDL

SEQ ID NO: 370 - protein, 100 aa, Artificial Sequence
  Description of Artificial Sequence: Synthetic polypeptide
EGHRMDKPANCTHDLYMIMRECWHAAPSQRPTFKQLVEDLDRVLTVTSTDVKATQEENRELRSRCEELHGKNLELGKIMDRFEEVVYQAMEEVQKQKELS

SEQ ID NO: 371 - protein, 107 aa, Artificial Sequence
  Description of Artificial Sequence: Synthetic polypeptide
RDNTLLLRRVELFSLSRQVARESTYLSSLKGSRLHPEELGGPPLKKLKQEATSKSQIMSLWGLVSKMPPEKVQRLYVDFPQHLRHLLGDWLESQPWEFLVGSDAFCC

SEQ ID NO: 372 - protein, 83 aa, Artificial Sequence
  Description of Artificial Sequence: Synthetic polypeptide
MSREMQDVDLAEVKPLVEKGETITGLLQEFDVQEALSVVSEDQSLFECAYGTPHLAKTEMTASSSSDYGQTSKMSPRVPQQDW

SEQ ID NO: 373 - protein, 101 aa, Artificial Sequence
  Description of Artificial Sequence: Synthetic polypeptide
VLDMHGFLRQALCRLRQEEPQSLQAAVRTDGFDEFKVRLQDLSSCITQGKAIETQSSSSEEIVPSPPSPPPLPRIYKPCFVCQDKSSGYHYGVSACEGCKG

SEQ ID NO: 374 - protein, 101 aa, Artificial Sequence
  Description of Artificial Sequence: Synthetic polypeptide
RSSPEQPRPSTSKAVSPPHLDGPPSPRSPVIGSEVFLPNSNHVASGAGEAAIETQSSSSEEIVPSPPSPPPLPRIYKPCFVCQDKSSGYHYGVSACEGCKG

SEQ ID NO: 375 - protein, 101 aa, Artificial Sequence
  Description of Artificial Sequence: Synthetic polypeptide
VARFNDLRFVGRSGRGKSFTLTITVFTNPPQVATYHRAIKITVDGPREPRNRTEKHSTMPDSPVDVKTQSRLTPPTMPPPPTTQGAPRTSSFTPTTLTNGT

SEQ ID NO: 376 - protein, 55 aa, Artificial Sequence
  Description of Artificial Sequence: Synthetic polypeptide
MALNSEALSVVSEDQSLFECAYGTPHLAKTEMTASSSSDYGQTSKMSPRVPQQDW

SEQ ID NO: 377 - protein, 9 aa, Artificial Sequence
  Description of Artificial Sequence: Synthetic peptide
GQYGKVYEG

SEQ ID NO: 378 - protein, 10 aa, Artificial Sequence
  Description of Artificial Sequence: Synthetic peptide
GQYGKVYEGV

SEQ ID NO: 379 - protein, 9 aa, Artificial Sequence
  Description of Artificial Sequence: Synthetic peptide
KLGGGQYGK

SEQ ID NO: 380 - protein, 10 aa, Artificial Sequence
  Description of Artificial Sequence: Synthetic peptide
KLGGGQYGKV

SEQ ID NO: 381 - protein, 9 aa, Artificial Sequence
  Description of Artificial Sequence: Synthetic peptide
KVYEGVWKK

SEQ ID NO: 382 - protein, 10 aa, Artificial Sequence
  Description of Artificial Sequence: Synthetic peptide
KVYEGVWKKY

SEQ ID NO: 383 - protein, 9 aa, Artificial Sequence
  Description of Artificial Sequence: Synthetic peptide
QYGKVYEGV

SEQ ID NO: 384 - protein, 10 aa, Artificial Sequence
  Description of Artificial Sequence: Synthetic peptide
QYGKVYEGVW

SEQ ID NO: 385 - protein, 9 aa, Artificial Sequence
  Description of Artificial Sequence: Synthetic peptide
GQYGVVYEG

SEQ ID NO: 386 - protein, 10 aa, Artificial Sequence
  Description of Artificial Sequence: Synthetic peptide
GQYGVVYEGV

SEQ ID NO: 387 - protein, 9 aa, Artificial Sequence
  Description of Artificial Sequence: Synthetic peptide
KLGGGQYGV

SEQ ID NO: 388 - protein, 10 aa, Artificial Sequence
  Description of Artificial Sequence: Synthetic peptide
KLGGGQYGVV

SEQ ID NO: 389 - protein, 9 aa, Artificial Sequence
  Description of Artificial Sequence: Synthetic peptide
QYGVVYEGV

SEQ ID NO: 390 - protein, 10 aa, Artificial Sequence
  Description of Artificial Sequence: Synthetic peptide
QYGVVYEGVW

SEQ ID NO: 391 - protein, 9 aa, Artificial Sequence
  Description of Artificial Sequence: Synthetic peptide
VVYEGVWKK

SEQ ID NO: 392 - protein, 10 aa, Artificial Sequence
  Description of Artificial Sequence: Synthetic peptide
VVYEGVWKKY

SEQ ID NO: 393 - protein, 10 aa, Artificial Sequence
  Description of Artificial Sequence: Synthetic peptide
ATQISSATEY

SEQ ID NO: 394 - protein, 10 aa, Artificial Sequence
  Description of Artificial Sequence: Synthetic peptide
ISSATEYLEK

SEQ ID NO: 395 - protein, 9 aa, Artificial Sequence
  Description of Artificial Sequence: Synthetic peptide
SSATEYLEK

SEQ ID NO: 396 - protein, 10 aa, Artificial Sequence
  Description of Artificial Sequence: Synthetic peptide
TQISSATEYL

SEQ ID NO: 397 - protein, 10 aa, Artificial Sequence
  Description of Artificial Sequence: Synthetic peptide
YMATQISSAT

SEQ ID NO: 398 - protein, 10 aa, Artificial Sequence
  Description of Artificial Sequence: Synthetic peptide
FYIIIEFMTY

SEQ ID NO: 399 - protein, 10 aa, Artificial Sequence
  Description of Artificial Sequence: Synthetic peptide
IIEFMTYGNL

SEQ ID NO: 400 - protein, 9 aa, Artificial Sequence
  Description of Artificial Sequence: Synthetic peptide
IIIEFMTYG

SEQ ID NO: 401 - protein, 10 aa, Artificial Sequence
  Description of Artificial Sequence: Synthetic peptide
IIIEFMTYGN

SEQ ID NO: 402 - protein, 10 aa, Artificial Sequence
  Description of Artificial Sequence: Synthetic peptide
YIIIEFMTYG

SEQ ID NO: 403 - protein, 10 aa, Artificial Sequence
  Description of Artificial Sequence: Synthetic peptide
GQHGEVYEGV

SEQ ID NO: 404 - protein, 10 aa, Artificial Sequence
  Description of Artificial Sequence: Synthetic peptide
KLGGGQHGEV

SEQ ID NO: 405 - protein, 9 aa, Artificial Sequence
  Description of Artificial Sequence: Synthetic peptide
KIADFGMAR

SEQ ID NO: 406 - protein, 10 aa, Artificial Sequence
  Description of Artificial Sequence: Synthetic peptide
RVAKIADFGM

SEQ ID NO: 407 - protein, 10 aa, Artificial Sequence
  Description of Artificial Sequence: Synthetic peptide
FILMELMAGG

SEQ ID NO: 408 - protein, 9 aa, Artificial Sequence
  Description of Artificial Sequence: Synthetic peptide
ILMELMAGG

SEQ ID NO: 409 - protein, 10 aa, Artificial Sequence
  Description of Artificial Sequence: Synthetic peptide
ILMELMAGGD

SEQ ID NO: 410 - protein, 10 aa, Artificial Sequence
  Description of Artificial Sequence: Synthetic peptide
LMELMAGGDL

SEQ ID NO: 411 - protein, 9 aa, Artificial Sequence
  Description of Artificial Sequence: Synthetic peptide
LPRFILMEL

SEQ ID NO: 412 - protein, 10 aa, Artificial Sequence
  Description of Artificial Sequence: Synthetic peptide
LPRFILMELM

SEQ ID NO: 413 - protein, 10 aa, Artificial Sequence
  Description of Artificial Sequence: Synthetic peptide
LQSLPRFILM

SEQ ID NO: 414 - protein, 10 aa, Artificial Sequence
  Description of Artificial Sequence: Synthetic peptide
SLPRFILMEL

SEQ ID NO: 415 - protein, 9 aa, Artificial Sequence
  Description of Artificial Sequence: Synthetic peptide
LATEKSRWS

SEQ ID NO: 416 - protein, 10 aa, Artificial Sequence
  Description of Artificial Sequence: Synthetic peptide
LATEKSRWSG

SEQ ID NO: 417 - protein, 9 aa, Artificial Sequence
  Description of Artificial Sequence: Synthetic peptide
EYMANGSLL

SEQ ID NO: 418 - protein, 9 aa, Artificial Sequence
  Description of Artificial Sequence: Synthetic peptide
MANGSLLNY

SEQ ID NO: 419 - protein, 10 aa, Artificial Sequence
  Description of Artificial Sequence: Synthetic peptide
MANGSLLNYL

SEQ ID NO: 420 - protein, 9 aa, Artificial Sequence
  Description of Artificial Sequence: Synthetic peptide
SLLNYLREM

SEQ ID NO: 421 - protein, 9 aa, Artificial Sequence
  Description of Artificial Sequence: Synthetic peptide
YMANGSLLN

SEQ ID NO: 422 - protein, 10 aa, Artificial Sequence
  Description of Artificial Sequence: Synthetic peptide
YMANGSLLNY

SEQ ID NO: 423 - protein, 11 aa, Artificial Sequence
  Description of Artificial Sequence: Synthetic peptide
GPPPADLCHAL

SEQ ID NO: 424 - protein, 11 aa, Artificial Sequence
  Description of Artificial Sequence: Synthetic peptide
IIRNRGENSCK

SEQ ID NO: 425 - protein, 10 aa, Artificial Sequence
  Description of Artificial Sequence: Synthetic peptide
CLTSTVQLIM

SEQ ID NO: 426 - protein, 9 aa, Artificial Sequence
  Description of Artificial Sequence: Synthetic peptide
IMQLMPFGC

SEQ ID NO: 427 - protein, 10 aa, Artificial Sequence
  Description of Artificial Sequence: Synthetic peptide
IMQLMPFGCL

SEQ ID NO: 428 - protein, 9 aa, Artificial Sequence
  Description of Artificial Sequence: Synthetic peptide
LIMQLMPFG

SEQ ID NO: 429 - protein, 10 aa, Artificial Sequence
  Description of Artificial Sequence: Synthetic peptide
LIMQLMPFGC

SEQ ID NO: 430 - protein, 9 aa, Artificial Sequence
  Description of Artificial Sequence: Synthetic peptide
LTSTVQLIM

SEQ ID NO: 431 - protein, 9 aa, Artificial Sequence
  Description of Artificial Sequence: Synthetic peptide
MQLMPFGCL

SEQ ID NO: 432 - protein, 10 aa, Artificial Sequence
  Description of Artificial Sequence: Synthetic peptide
MQLMPFGCLL

SEQ ID NO: 433 - protein, 9 aa, Artificial Sequence
  Description of Artificial Sequence: Synthetic peptide
QLIMQLMPF

SEQ ID NO: 434 - protein, 10 aa, Artificial Sequence
  Description of Artificial Sequence: Synthetic peptide
QLIMQLMPFG

SEQ ID NO: 435 - protein, 9 aa, Artificial Sequence
  Description of Artificial Sequence: Synthetic peptide
STVQLIMQL

SEQ ID NO: 436 - protein, 10 aa, Artificial Sequence
  Description of Artificial Sequence: Synthetic peptide
VQLIMQLMPF

SEQ ID NO: 437 - protein, 9 aa, Artificial Sequence
  Description of Artificial Sequence: Synthetic peptide
GLLLEMLDA

SEQ ID NO: 438 - protein, 9 aa, Artificial Sequence
  Description of Artificial Sequence: Synthetic peptide
LYGLLLEML

SEQ ID NO: 439 - protein, 9 aa, Artificial Sequence
  Description of Artificial Sequence: Synthetic peptide
NVVPLYGLL

SEQ ID NO: 440 - protein, 9 aa, Artificial Sequence
  Description of Artificial Sequence: Synthetic peptide
PLYGLLLEM

SEQ ID NO: 441 - protein, 10 aa, Artificial Sequence
  Description of Artificial Sequence: Synthetic peptide
PLYGLLLEML

SEQ ID NO: 442 - protein, 10 aa, Artificial Sequence
  Description of Artificial Sequence: Synthetic peptide
VPLYGLLLEM

SEQ ID NO: 443 - protein, 9 aa, Artificial Sequence
  Description of Artificial Sequence: Synthetic peptide
VVPLYGLLL

SEQ ID NO: 444 - protein, 9 aa, Artificial Sequence
  Description of Artificial Sequence: Synthetic peptide
FLPSTLKSL

SEQ ID NO: 445 - protein, 9 aa, Artificial Sequence
  Description of Artificial Sequence: Synthetic peptide
GVYTFLPST

SEQ ID NO: 446 - protein, 10 aa, Artificial Sequence
  Description of Artificial Sequence: Synthetic peptide
GVYTFLPSTL

SEQ ID NO: 447 - protein, 10 aa, Artificial Sequence
  Description of Artificial Sequence: Synthetic peptide
TFLPSTLKSL

SEQ ID NO: 448 - protein, 9 aa, Artificial Sequence
  Description of Artificial Sequence: Synthetic peptide
VYTFLPSTL

SEQ ID NO: 449 - protein, 9 aa, Artificial Sequence
  Description of Artificial Sequence: Synthetic peptide
YTFLPSTLK

SEQ ID NO: 450 - protein, 9 aa, Artificial Sequence
  Description of Artificial Sequence: Synthetic peptide
NVVPLCDLL

SEQ ID NO: 451 - protein, 10 aa, Artificial Sequence
  Description of Artificial Sequence: Synthetic peptide
NVVPLCDLLL

SEQ ID NO: 452 - protein, 9 aa, Artificial Sequence
  Description of Artificial Sequence: Synthetic peptide
PLCDLLLEM

SEQ ID NO: 453 - protein, 10 aa, Artificial Sequence
  Description of Artificial Sequence: Synthetic peptide
PLCDLLLEML

SEQ ID NO: 454 - protein, 10 aa, Artificial Sequence
  Description of Artificial Sequence: Synthetic peptide
VPLCDLLLEM

SEQ ID NO: 455 - protein, 9 aa, Artificial Sequence
  Description of Artificial Sequence: Synthetic peptide
VVPLCDLLL

SEQ ID NO: 456 - protein, 9 aa, Artificial Sequence
  Description of Artificial Sequence: Synthetic peptide
NVVPLNDLL

SEQ ID NO: 457 - protein, 10 aa, Artificial Sequence
  Description of Artificial Sequence: Synthetic peptide
NVVPLNDLLL

SEQ ID NO: 458 - protein, 9 aa, Artificial Sequence
  Description of Artificial Sequence: Synthetic peptide
PLNDLLLEM

SEQ ID NO: 459 - protein, 10 aa, Artificial Sequence
  Description of Artificial Sequence: Synthetic peptide
PLNDLLLEML

SEQ ID NO: 460 - protein, 10 aa, Artificial Sequence
  Description of Artificial Sequence: Synthetic peptide
VPLNDLLLEM

SEQ ID NO: 461 - protein, 9 aa, Artificial Sequence
  Description of Artificial Sequence: Synthetic peptide
NVVPLSDLL

SEQ ID NO: 462 - protein, 10 aa, Artificial Sequence
  Description of Artificial Sequence: Synthetic peptide
NVVPLSDLLL

SEQ ID NO: 463 - protein, 9 aa, Artificial Sequence
  Description of Artificial Sequence: Synthetic peptide
PLSDLLLEM

SEQ ID NO: 464 - protein, 10 aa, Artificial Sequence
  Description of Artificial Sequence: Synthetic peptide
PLSDLLLEML

SEQ ID NO: 465 - protein, 10 aa, Artificial Sequence
  Description of Artificial Sequence: Synthetic peptide
VPLSDLLLEM

SEQ ID NO: 466 - protein, 9 aa, Artificial Sequence
  Description of Artificial Sequence: Synthetic peptide
VVPLSDLLL

SEQ ID NO: 467 - protein, 10 aa, Artificial Sequence
  Description of Artificial Sequence: Synthetic peptide
VLERCPHRPI

SEQ ID NO: 468 - protein, 9 aa, Artificial Sequence
  Description of Artificial Sequence: Synthetic peptide
YTLDVLERC

SEQ ID NO: 469 - protein, 9 aa, Artificial Sequence
  Description of Artificial Sequence: Synthetic peptide
FQNGKMALS

SEQ ID NO: 470 - protein, 10 aa, Artificial Sequence
  Description of Artificial Sequence: Synthetic peptide
VMAGLGSPYV

SEQ ID NO: 471 - protein, 9 aa, Artificial Sequence
  Description of Artificial Sequence: Synthetic peptide
KPIIIGHHA

SEQ ID NO: 472 - protein, 9 aa, Artificial Sequence
  Description of Artificial Sequence: Synthetic peptide
KPIIIGCHA

SEQ ID NO: 473 - protein, 9 aa, Artificial Sequence
  Description of Artificial Sequence: Synthetic peptide
KPIIIGGHA

SEQ ID NO: 474 - protein, 9 aa, Artificial Sequence
  Description of Artificial Sequence: Synthetic peptide
KPIIIGSHA

SEQ ID NO: 475 - protein, 10 aa, Artificial Sequence
  Description of Artificial Sequence: Synthetic peptide
IIEYCCYGDL

SEQ ID NO: 476 - protein, 10 aa, Artificial Sequence
  Description of Artificial Sequence: Synthetic peptide
TIGGPTLVII

SEQ ID NO: 477 - protein, 9 aa, Artificial Sequence
  Description of Artificial Sequence: Synthetic peptide
VIIEYCCYG

SEQ ID NO: 478 - protein, 10 aa, Artificial Sequence
  Description of Artificial Sequence: Synthetic peptide
HMNIANLLGA

SEQ ID NO: 479 - protein, 10 aa, Artificial Sequence
  Description of Artificial Sequence: Synthetic peptide
IANLLGACTI

SEQ ID NO: 480 - protein, 9 aa, Artificial Sequence
  Description of Artificial Sequence: Synthetic peptide
MNIANLLGA

SEQ ID NO: 481 - protein, 9 aa, Artificial Sequence
  Description of Artificial Sequence: Synthetic peptide
YLGNHMNIA

SEQ ID NO: 482 - protein, 10 aa, Artificial Sequence
  Description of Artificial Sequence: Synthetic peptide
YLGNHMNIAN

SEQ ID NO: 483 - protein, 9 aa, Artificial Sequence
  Description of Artificial Sequence: Synthetic peptide
VLHESNSPY

SEQ ID NO: 484 - protein, 10 aa, Artificial Sequence
  Description of Artificial Sequence: Synthetic peptide
VLHESNSPYI

SEQ ID NO: 485 - protein, 10 aa, Artificial Sequence
  Description of Artificial Sequence: Synthetic peptide
LQVLHECNSL

SEQ ID NO: 486 - protein, 10 aa, Artificial Sequence
  Description of Artificial Sequence: Synthetic peptide
LYIVGFYGAF

SEQ ID NO: 487 - protein, 9 aa, Artificial Sequence
  Description of Artificial Sequence: Synthetic peptide
NSLYIVGFY

SEQ ID NO: 488 - protein, 9 aa, Artificial Sequence
  Description of Artificial Sequence: Synthetic peptide
QVLHECNSL

SEQ ID NO: 489 - protein, 9 aa, Artificial Sequence
  Description of Artificial Sequence: Synthetic peptide
SLYIVGFYG

SEQ ID NO: 490 - protein, 10 aa, Artificial Sequence
  Description of Artificial Sequence: Synthetic peptide
SLYIVGFYGA

SEQ ID NO: 491 - protein, 9 aa, Artificial Sequence
  Description of Artificial Sequence: Synthetic peptide
VLHECNSLY

SEQ ID NO: 492 - protein, 10 aa, Artificial Sequence
  Description of Artificial Sequence: Synthetic peptide
VLHECNSLYI

SEQ ID NO: 493 - protein, 10 aa, Artificial Sequence
  Description of Artificial Sequence: Synthetic peptide
FYQQQQQSDL

SEQ ID NO: 494 - protein, 10 aa, Artificial Sequence
  Description of Artificial Sequence: Synthetic peptide
QQQSDLQPPA

SEQ ID NO: 495 - protein, 9 aa, Artificial Sequence
  Description of Artificial Sequence: Synthetic peptide
QQSDLQPPA

SEQ ID NO: 496 - protein, 9 aa, Artificial Sequence
  Description of Artificial Sequence: Synthetic peptide
YQQQQQSDL

SEQ ID NO: 497 - protein, 9 aa, Artificial Sequence
  Description of Artificial Sequence: Synthetic peptide
FELLSTPPL

SEQ ID NO: 498 - protein, 10 aa, Artificial Sequence
  Description of Artificial Sequence: Synthetic peptide
LLSTPPLSPS

SEQ ID NO: 499 - protein, 9 aa, Artificial Sequence
  Description of Artificial Sequence: Synthetic peptide
FELLPIPPL

SEQ ID NO: 500 - protein, 10 aa, Artificial Sequence
  Description of Artificial Sequence: Synthetic peptide
IWKKFELLPI

SEQ ID NO: 501 - protein, 10 aa, Artificial Sequence
  Description of Artificial Sequence: Synthetic peptide
LLPIPPLSPS

SEQ ID NO: 502 - protein, 9 aa, Artificial Sequence
  Description of Artificial Sequence: Synthetic peptide
LPIPPLSPS

SEQ ID NO: 503 - protein, 10 aa, Artificial Sequence
  Description of Artificial Sequence: Synthetic peptide
IIEYCFYGDL

SEQ ID NO: 504 - protein, 9 aa, Artificial Sequence
  Description of Artificial Sequence: Synthetic peptide
IIIEYCFYG

SEQ ID NO: 505 - protein, 9 aa, Artificial Sequence
  Description of Artificial Sequence: Synthetic peptide
IYIIIEYCF

SEQ ID NO: 506 - protein, 10 aa, Artificial Sequence
  Description of Artificial Sequence: Synthetic peptide
IYIIIEYCFY

SEQ ID NO: 507 - protein, 10 aa, Artificial Sequence
  Description of Artificial Sequence: Synthetic peptide
YIIIEYCFYG

SEQ ID NO: 508 - protein, 10 aa, Artificial Sequence
  Description of Artificial Sequence: Synthetic peptide
KITEQEKDFL

SEQ ID NO: 509 - protein, 11 aa, Artificial Sequence
  Description of Artificial Sequence: Synthetic peptide
STRDPLSEITK

SEQ ID NO: 510 - protein, 8 aa, Artificial Sequence
  Description of Artificial Sequence: Synthetic peptide
DPLSEITK

SEQ ID NO: 511 - protein, 10 aa, Artificial Sequence
  Description of Artificial Sequence: Synthetic peptide
LPLKFRDAET

SEQ ID NO: 512 - protein, 10 aa, Artificial Sequence
  Description of Artificial Sequence: Synthetic peptide
QTGVMICAYL

SEQ ID NO: 513 - protein, 10 aa, Artificial Sequence
  Description of Artificial Sequence: Synthetic peptide
AFSGEYIPTV

SEQ ID NO: 514 - protein, 9 aa, Artificial Sequence
  Description of Artificial Sequence: Synthetic peptide
SMNRRPILT

SEQ ID NO: 515 - protein, 10 aa, Artificial Sequence
  Description of Artificial Sequence: Synthetic peptide
YMCNSSCMGS

SEQ ID NO: 516 - protein, 9 aa, Artificial Sequence
  Description of Artificial Sequence: Synthetic peptide
GMNQRPILT

SEQ ID NO: 517 - protein, 9 aa, Artificial Sequence
  Description of Artificial Sequence: Synthetic peptide
GMNWRPILT

SEQ ID NO: 518 - protein, 10 aa, Artificial Sequence
  Description of Artificial Sequence: Synthetic peptide
LLGRNSFEVC

SEQ ID NO: 519 - protein, 9 aa, Artificial Sequence
  Description of Artificial Sequence: Synthetic peptide
ALKYIFVAV

SEQ ID NO: 520 - protein, 10 aa, Artificial Sequence
  Description of Artificial Sequence: Synthetic peptide
ALKYIFVAVR

SEQ ID NO: 521 - protein, 9 aa, Artificial Sequence
  Description of Artificial Sequence: Synthetic peptide
AVRAICVMK

SEQ ID NO: 522 - protein, 10 aa, Artificial Sequence
  Description of Artificial Sequence: Synthetic peptide
AVRAICVMKS

SEQ ID NO: 523 - protein, 9 aa, Artificial Sequence
  Description of Artificial Sequence: Synthetic peptide
CVEKKTALK

SEQ ID NO: 524 - protein, 10 aa, Artificial Sequence
  Description of Artificial Sequence: Synthetic peptide
CVEKKTALKY

SEQ ID NO: 525 - protein, 9 aa, Artificial Sequence
  Description of Artificial Sequence: Synthetic peptide
CVMKSFLIF

SEQ ID NO: 526 - protein, 10 aa, Artificial Sequence
  Description of Artificial Sequence: Synthetic peptide
CVMKSFLIFR

SEQ ID NO: 527 - protein, 9 aa, Artificial Sequence
  Description of Artificial Sequence: Synthetic peptide
FLIFRRWKS

SEQ ID NO: 528 - protein, 10 aa, Artificial Sequence
  Description of Artificial Sequence: Synthetic peptide
FRRWKSHSPL

SEQ ID NO: 529 - protein, 9 aa, Artificial Sequence
  Description of Artificial Sequence: Synthetic peptide
FVAVRAICV

SEQ ID NO: 530 - protein, 10 aa, Artificial Sequence
  Description of Artificial Sequence: Synthetic peptide
FVAVRAICVM

SEQ ID NO: 531 - protein, 9 aa, Artificial Sequence
  Description of Artificial Sequence: Synthetic peptide
IQLHLSHPI

SEQ ID NO: 532 - protein, 10 aa, Artificial Sequence
  Description of Artificial Sequence: Synthetic peptide
KSFLIFRRWK

SEQ ID NO: 533 - protein, 9 aa, Artificial Sequence
  Description of Artificial Sequence: Synthetic peptide
KTALKYIFV

SEQ ID NO: 534 - protein, 10 aa, Artificial Sequence
  Description of Artificial Sequence: Synthetic peptide
KYIFVAVRAI

SEQ ID NO: 535 - protein, 10 aa, Artificial Sequence
  Description of Artificial Sequence: Synthetic peptide
RWKSHSPLQI

SEQ ID NO: 536 - protein, 10 aa, Artificial Sequence
  Description of Artificial Sequence: Synthetic peptide
TALKYIFVAV

SEQ ID NO: 537 - protein, 10 aa, Artificial Sequence
  Description of Artificial Sequence: Synthetic peptide
VAVRAICVMK

SEQ ID NO: 538 - protein, 9 aa, Artificial Sequence
  Description of Artificial Sequence: Synthetic peptide
VMKSFLIFR

SEQ ID NO: 539 - protein, 10 aa, Artificial Sequence
  Description of Artificial Sequence: Synthetic peptide
VMKSFLIFRR

SEQ ID NO: 540 - protein, 9 aa, Artificial Sequence
  Description of Artificial Sequence: Synthetic peptide
YIFVAVRAI

SEQ ID NO: 541 - protein, 9 aa, Artificial Sequence
  Description of Artificial Sequence: Synthetic peptide
ALFFFFFET

SEQ ID NO: 542 - protein, 10 aa, Artificial Sequence
  Description of Artificial Sequence: Synthetic peptide
ALFFFFFETK

SEQ ID NO: 543 - protein, 10 aa, Artificial Sequence
  Description of Artificial Sequence: Synthetic peptide
AQAGVQWRSL

SEQ ID NO: 544 - protein, 10 aa, Artificial Sequence
  Description of Artificial Sequence: Synthetic peptide
CLANFCIFNR

SEQ ID NO: 545 - protein, 10 aa, Artificial Sequence
  Description of Artificial Sequence: Synthetic peptide
CLSFLSSWDY

SEQ ID NO: 546 - protein, 9 aa, Artificial Sequence
  Description of Artificial Sequence: Synthetic peptide
FFETKSCSV

SEQ ID NO: 547 - protein, 10 aa, Artificial Sequence
  Description of Artificial Sequence: Synthetic peptide
FFFETKSCSV

SEQ ID NO: 548 - protein, 10 aa, Artificial Sequence
  Description of Artificial Sequence: Synthetic peptide
FKLFSCLSFL

SEQ ID NO: 549 - protein, 10 aa, Artificial Sequence
  Description of Artificial Sequence: Synthetic peptide
FLSSWDYRRM

SEQ ID NO: 550 - protein, 10 aa, Artificial Sequence
  Description of Artificial Sequence: Synthetic peptide
GFKLFSCLSF

SEQ ID NO: 551 - protein, 9 aa, Artificial Sequence
  Description of Artificial Sequence: Synthetic peptide
KLFSCLSFL

SEQ ID NO: 552 - protein, 10 aa, Artificial Sequence
  Description of Artificial Sequence: Synthetic peptide
KLFSCLSFLS

SEQ ID NO: 553 - protein, 10 aa, Artificial Sequence
  Description of Artificial Sequence: Synthetic peptide
LALFFFFFET

SEQ ID NO: 554 - protein, 9 aa, Artificial Sequence
  Description of Artificial Sequence: Synthetic peptide
LFFFFFETK

SEQ ID NO: 555 - protein, 9 aa, Artificial Sequence
  Description of Artificial Sequence: Synthetic peptide
LSFLSSWDY

SEQ ID NO: 556 - protein, 10 aa, Artificial Sequence
  Description of Artificial Sequence: Synthetic peptide
LSFLSSWDYR

SEQ ID NO: 557 - protein, 9 aa, Artificial Sequence
  Description of Artificial Sequence: Synthetic peptide
RMPPCLANF

SEQ ID NO: 558 - protein, 10 aa, Artificial Sequence
  Description of Artificial Sequence: Synthetic peptide
RRMPPCLANF

SEQ ID NO: 559 - protein, 10 aa, Artificial Sequence
  Description of Artificial Sequence: Synthetic peptide
SLQPPPPGFK

SEQ ID NO: 560 - protein, 9 aa, Artificial Sequence
  Description of Artificial Sequence: Synthetic peptide
VQWRSLGSL

SEQ ID NO: 561 - protein, 9 aa, Artificial Sequence
  Description of Artificial Sequence: Synthetic peptide
FFFSVIFST

SEQ ID NO: 562 - protein, 10 aa, Artificial Sequence
  Description of Artificial Sequence: Synthetic peptide
MSVCFFFFSV

SEQ ID NO: 563 - protein, 9 aa, Artificial Sequence
  Description of Artificial Sequence: Synthetic peptide
SVCFFFFSV

SEQ ID NO: 564 - protein, 10 aa, Artificial Sequence
  Description of Artificial Sequence: Synthetic peptide
SVCFFFFSVI

SEQ ID NO: 565 - protein, 10 aa, Artificial Sequence
  Description of Artificial Sequence: Synthetic peptide
FFCYILNTMF

SEQ ID NO: 566 - protein, 10 aa, Artificial Sequence
  Description of Artificial Sequence: Synthetic peptide
MSVCFFFFCY

SEQ ID NO: 567 - protein, 10 aa, Artificial Sequence
  Description of Artificial Sequence: Synthetic peptide
SVCFFFFCYI

SEQ ID NO: 568 - protein, 9 aa, Artificial Sequence
  Description of Artificial Sequence: Synthetic peptide
KQWSSVTSL

SEQ ID NO: 569 - protein, 9 aa, Artificial Sequence
  Description of Artificial Sequence: Synthetic peptide
VLWMPTSTV

SEQ ID NO: 570 - protein, 9 aa, Artificial Sequence
  Description of Artificial Sequence: Synthetic peptide
ILIRKAMTV

SEQ ID NO: 571 - protein, 8 aa, Artificial Sequence
  Description of Artificial Sequence: Synthetic peptide
RMKVPLMK

SEQ ID NO: 572 - protein, 9 aa, Artificial Sequence
  Description of Artificial Sequence: Synthetic peptide
TLKKKPRDI

SEQ ID NO: 573 - protein, 10 aa, Artificial Sequence
  Description of Artificial Sequence: Synthetic peptide
LIEGFEALLK

SEQ ID NO: 574 - protein, 9 aa, Artificial Sequence
  Description of Artificial Sequence: Synthetic peptide
QQLKWTPHI

SEQ ID NO: 575 - protein, 10 aa, Artificial Sequence
  Description of Artificial Sequence: Synthetic peptide
QLKWTPHILK

SEQ ID NO: 576 - protein, 10 aa, Artificial Sequence
  Description of Artificial Sequence: Synthetic peptide
IVSEKNQQLK

SEQ ID NO: 577 - protein, 10 aa, Artificial Sequence
  Description of Artificial Sequence: Synthetic peptide
QLKWTPHILK

SEQ ID NO: 578 - protein, 9 aa, Artificial Sequence
  Description of Artificial Sequence: Synthetic peptide
QQLKWTPHI

SEQ ID NO: 579 - protein, 11 aa, Artificial Sequence
  Description of Artificial Sequence: Synthetic peptide
NQQLKWTPHIL

SEQ ID NO: 580 - protein, 10 aa, Artificial Sequence
  Description of Artificial Sequence: Synthetic peptide
NQQLKWTPHI

SEQ ID NO: 581 - protein, 9 aa, Artificial Sequence
  Description of Artificial Sequence: Synthetic peptide
QLKWTPHIL

SEQ ID NO: 582 - protein, 10 aa, Artificial Sequence
  Description of Artificial Sequence: Synthetic peptide
GPPRPPRAAC

SEQ ID NO: 583 - protein, 9 aa, Artificial Sequence
  Description of Artificial Sequence: Synthetic peptide
PPRPPRAAC

SEQ ID NO: 584 - protein, 9 aa, Artificial Sequence
  Description of Artificial Sequence: Synthetic peptide
SLRRKYLRV

SEQ ID NO: 585 - protein, 10 aa, Artificial Sequence
  Description of Artificial Sequence: Synthetic peptide
SAACHRRGCV

SEQ ID NO: 586 - protein, 10 aa, Artificial Sequence
  Description of Artificial Sequence: Synthetic peptide
ALWECSLPQA

SEQ ID NO: 587 - protein, 9 aa, Artificial Sequence
  Description of Artificial Sequence: Synthetic peptide
CLIVSRTLL

SEQ ID NO: 588 - protein, 10 aa, Artificial Sequence
  Description of Artificial Sequence: Synthetic peptide
CLIVSRTLLL

SEQ ID NO: 589 - protein, 9 aa, Artificial Sequence
  Description of Artificial Sequence: Synthetic peptide
FLLALWECS

SEQ ID NO: 590 - protein, 10 aa, Artificial Sequence
  Description of Artificial Sequence: Synthetic peptide
FLLALWECSL

SEQ ID NO: 591 - protein, 9 aa, Artificial Sequence
  Description of Artificial Sequence: Synthetic peptide
IVSRTLLLV

SEQ ID NO: 592 - protein, 9 aa, Artificial Sequence
  Description of Artificial Sequence: Synthetic peptide
LIVSRTLLL

SEQ ID NO: 593 - protein, 10 aa, Artificial Sequence
  Description of Artificial Sequence: Synthetic peptide
LIVSRTLLLV

SEQ ID NO: 594 - protein, 9 aa, Artificial Sequence
  Description of Artificial Sequence: Synthetic peptide
LLALWECSL

SEQ ID NO: 595 - protein, 9 aa, Artificial Sequence
  Description of Artificial Sequence: Synthetic peptide
LPQARLCLI

SEQ ID NO: 596 - protein, 10 aa, Artificial Sequence
  Description of Artificial Sequence: Synthetic peptide
LPQARLCLIV

SEQ ID NO: 597 - protein, 10 aa, Artificial Sequence
  Description of Artificial Sequence: Synthetic peptide
NVRDKKRATF

SEQ ID NO: 598 - protein, 10 aa, Artificial Sequence
  Description of Artificial Sequence: Synthetic peptide
SLPQARLCLI

SEQ ID NO: 599 - protein, 9 aa, Artificial Sequence
  Description of Artificial Sequence: Synthetic peptide
FFCWILSCK

SEQ ID NO: 600 - protein, 10 aa, Artificial Sequence
  Description of Artificial Sequence: Synthetic peptide
FFFCWILSCK

SEQ ID NO: 601 - protein, 9 aa, Artificial Sequence
  Description of Artificial Sequence: Synthetic peptide
ITAFFFCWI

SEQ ID NO: 602 - protein, 10 aa, Artificial Sequence
  Description of Artificial Sequence: Synthetic peptide
LYITAFFFCW

SEQ ID NO: 603 - protein, 10 aa, Artificial Sequence
  Description of Artificial Sequence: Synthetic peptide
YITAFFFCWI

SEQ ID NO: 604 - protein, 9 aa, Artificial Sequence
  Description of Artificial Sequence: Synthetic peptide
ITAFFLLDI

SEQ ID NO: 605 - protein, 9 aa, Artificial Sequence
  Description of Artificial Sequence: Synthetic peptide
LLYITAFFL

SEQ ID NO: 606 - protein, 10 aa, Artificial Sequence
  Description of Artificial Sequence: Synthetic peptide
LLYITAFFLL

SEQ ID NO: 607 - protein, 9 aa, Artificial Sequence
  Description of Artificial Sequence: Synthetic peptide
LYITAFFLL

SEQ ID NO: 608 - protein, 10 aa, Artificial Sequence
  Description of Artificial Sequence: Synthetic peptide
LYITAFFLLD

SEQ ID NO: 609 - protein, 10 aa, Artificial Sequence
  Description of Artificial Sequence: Synthetic peptide
YITAFFLLDI

SEQ ID NO: 610 - protein, 9 aa, Artificial Sequence
  Description of Artificial Sequence: Synthetic peptide
GSNEVTTRY

SEQ ID NO: 611 - protein, 9 aa, Artificial Sequence
  Description of Artificial Sequence: Synthetic peptide
MPKDVNIQV

SEQ ID NO: 612 - protein, 10 aa, Artificial Sequence
  Description of Artificial Sequence: Synthetic peptide
TGSNEVTTRY

SEQ ID NO: 613 - protein, 10 aa, Artificial Sequence
  Description of Artificial Sequence: Synthetic peptide
KKLMLLRLNL

SEQ ID NO: 614 - protein, 9 aa, Artificial Sequence
  Description of Artificial Sequence: Synthetic peptide
KLMLLRLNL

SEQ ID NO: 615 - protein, 10 aa, Artificial Sequence
  Description of Artificial Sequence: Synthetic peptide
KLMLLRLNLR

SEQ ID NO: 616 - protein, 9 aa, Artificial Sequence
  Description of Artificial Sequence: Synthetic peptide
LLRLNLRKM

SEQ ID NO: 617 - protein, 8 aa, Artificial Sequence
  Description of Artificial Sequence: Synthetic peptide
LMLLRLNL

SEQ ID NO: 618 - protein, 10 aa, Artificial Sequence
  Description of Artificial Sequence: Synthetic peptide
LMLLRLNLRK

SEQ ID NO: 619 - protein, 10 aa, Artificial Sequence
  Description of Artificial Sequence: Synthetic peptide
LNLRKMCGPF

SEQ ID NO: 620 - protein, 9 aa, Artificial Sequence
  Description of Artificial Sequence: Synthetic peptide
MLLRLNLRK

SEQ ID NO: 621 - protein, 10 aa, Artificial Sequence
  Description of Artificial Sequence: Synthetic peptide
MLLRLNLRKM

SEQ ID NO: 622 - protein, 9 aa, Artificial Sequence
  Description of Artificial Sequence: Synthetic peptide
NLRKMCGPF

SEQ ID NO: 623 - protein, 10 aa, Artificial Sequence
  Description of Artificial Sequence: Synthetic peptide
NYCQKKLMLL

SEQ ID NO: 624 - protein, 9 aa, Artificial Sequence
  Description of Artificial Sequence: Synthetic peptide
YCQKKLMLL

SEQ ID NO: 625 - protein, 10 aa, Artificial Sequence
  Description of Artificial Sequence: Synthetic peptide
FKKKTYTCAI

SEQ ID NO: 626 - protein, 10 aa, Artificial Sequence
  Description of Artificial Sequence: Synthetic peptide
ITTVKATETK

SEQ ID NO: 627 - protein, 9 aa, Artificial Sequence
  Description of Artificial Sequence: Synthetic peptide
KSKKKETFK

SEQ ID NO: 628 - protein, 10 aa, Artificial Sequence
  Description of Artificial Sequence: Synthetic peptide
KSKKKETFKK

SEQ ID NO: 629 - protein, 10 aa, Artificial Sequence
  Description of Artificial Sequence: Synthetic peptide
KTYTCAITTV

SEQ ID NO: 630 - protein, 9 aa, Artificial Sequence
  Description of Artificial Sequence: Synthetic peptide
TFKKKTYTC

SEQ ID NO: 631 - protein, 9 aa, Artificial Sequence
  Description of Artificial Sequence: Synthetic peptide
TYTCAITTV

SEQ ID NO: 632 - protein, 10 aa, Artificial Sequence
  Description of Artificial Sequence: Synthetic peptide
TYTCAITTVK

SEQ ID NO: 633 - protein, 9 aa, Artificial Sequence
  Description of Artificial Sequence: Synthetic peptide
YTCAITTVK

SEQ ID NO: 634 - protein, 9 aa, Artificial Sequence
  Description of Artificial Sequence: Synthetic peptide
TAKSKKRNL

SEQ ID NO: 635 - protein, 9 aa, Artificial Sequence
  Description of Artificial Sequence: Synthetic peptide
FALCGFWQI

SEQ ID NO: 636 - protein, 8 aa, Artificial Sequence
  Description of Artificial Sequence: Synthetic peptide
LKKLRSPL

SEQ ID NO: 637 - protein, 8 aa, Artificial Sequence
  Description of Artificial Sequence: Synthetic peptide
SLKKVPAL

SEQ ID NO: 638 - protein, 10 aa, Artificial Sequence
  Description of Artificial Sequence: Synthetic peptide
RKISNWSLKK

SEQ ID NO: 639 - protein, 11 aa, Artificial Sequence
  Description of Artificial Sequence: Synthetic peptide
VPALKKLRSPL

SEQ ID NO: 640 - protein, 10 aa, Artificial Sequence
  Description of Artificial Sequence: Synthetic peptide
KRVNTAWKTK

SEQ ID NO: 641 - protein, 10 aa, Artificial Sequence
  Description of Artificial Sequence: Synthetic peptide
MTKKKRVNTA

SEQ ID NO: 642 - protein, 9 aa, Artificial Sequence
  Description of Artificial Sequence: Synthetic peptide
RVNTAWKTK

SEQ ID NO: 643 - protein, 10 aa, Artificial Sequence
  Description of Artificial Sequence: Synthetic peptide
RVNTAWKTKK

SEQ ID NO: 644 - protein, 9 aa, Artificial Sequence
  Description of Artificial Sequence: Synthetic peptide
TKKKRVNTA

SEQ ID NO: 645 - protein, 10 aa, Artificial Sequence
  Description of Artificial Sequence: Synthetic peptide
WKTKKTSFSL

SEQ ID NO: 646 - protein, 9 aa, Artificial Sequence
  Description of Artificial Sequence: Synthetic peptide
ALMSAMTTS

SEQ ID NO: 647 - protein, 9 aa, Artificial Sequence
  Description of Artificial Sequence: Synthetic peptide
AMTTSSSQK

SEQ ID NO: 648 - protein, 10 aa, Artificial Sequence
  Description of Artificial Sequence: Synthetic peptide
AMTTSSSQKN

SEQ ID NO: 649 - protein, 9 aa, Artificial Sequence
  Description of Artificial Sequence: Synthetic peptide
CIMKEKKSL

SEQ ID NO: 650 - protein, 10 aa, Artificial Sequence
  Description of Artificial Sequence: Synthetic peptide
CIMKEKKSLV

SEQ ID NO: 651 - protein, 8 aa, Artificial Sequence
  Description of Artificial Sequence: Synthetic peptide
IMKEKKSL

SEQ ID NO: 652 - protein, 9 aa, Artificial Sequence
  Description of Artificial Sequence: Synthetic peptide
IMKEKKSLV

SEQ ID NO: 653 - protein, 10 aa, Artificial Sequence
  Description of Artificial Sequence: Synthetic peptide
KSLVRLSSCV

SEQ ID NO: 654 - protein, 10 aa, Artificial Sequence
  Description of Artificial Sequence: Synthetic peptide
LVRLSSCVPV

SEQ ID NO: 655 - protein, 9 aa, Artificial Sequence
  Description of Artificial Sequence: Synthetic peptide
RLSSCVPVA

SEQ ID NO: 656 - protein, 10 aa, Artificial Sequence
  Description of Artificial Sequence: Synthetic peptide
RLSSCVPVAL

SEQ ID NO: 657 - protein, 10 aa, Artificial Sequence
  Description of Artificial Sequence: Synthetic peptide
SAMTTSSSQK

SEQ ID NO: 658 - protein, 9 aa, Artificial Sequence
  Description of Artificial Sequence: Synthetic peptide
SLVRLSSCV

SEQ ID NO: 659 - protein, 9 aa, Artificial Sequence
  Description of Artificial Sequence: Synthetic peptide
VPVALMSAM

SEQ ID NO: 660 - protein, 10 aa, Artificial Sequence
  Description of Artificial Sequence: Synthetic peptide
VRLSSCVPVA

SEQ ID NO: 661 - protein, 9 aa, Artificial Sequence
  Description of Artificial Sequence: Synthetic peptide
KMRKKYAQK

SEQ ID NO: 662 - protein, 9 aa, Artificial Sequence
  Description of Artificial Sequence: Synthetic peptide
FVMSDTTYK

SEQ ID NO: 663 - protein, 10 aa, Artificial Sequence
  Description of Artificial Sequence: Synthetic peptide
FVMSDTTYKI

SEQ ID NO: 664 - protein, 9 aa, Artificial Sequence
  Description of Artificial Sequence: Synthetic peptide
KTFEKKGEK

SEQ ID NO: 665 - protein, 10 aa, Artificial Sequence
  Description of Artificial Sequence: Synthetic peptide
LFVMSDTTYK

SEQ ID NO: 666 - protein, 9 aa, Artificial Sequence
  Description of Artificial Sequence: Synthetic peptide
MSDTTYKIY

SEQ ID NO: 667 - protein, 9 aa, Artificial Sequence
  Description of Artificial Sequence: Synthetic peptide
VMSDTTYKI

SEQ ID NO: 668 - protein, 10 aa, Artificial Sequence
  Description of Artificial Sequence: Synthetic peptide
VMSDTTYKIY

SEQ ID NO: 669 - protein, 10 aa, Artificial Sequence
  Description of Artificial Sequence: Synthetic peptide
YLTKWPKFFL

SEQ ID NO: 670 - protein, 9 aa, Artificial Sequence
  Description of Artificial Sequence: Synthetic peptide
FLQERNLPP

SEQ ID NO: 671 - protein, 9 aa, Artificial Sequence
  Description of Artificial Sequence: Synthetic peptide
FRRPHSCLA

SEQ ID NO: 672 - protein, 9 aa, Artificial Sequence
  Description of Artificial Sequence: Synthetic peptide
LIVLRVVRL

SEQ ID NO: 673 - protein, 9 aa, Artificial Sequence
  Description of Artificial Sequence: Synthetic peptide
LLSVHLIVL

SEQ ID NO: 674 - protein, 9 aa, Artificial Sequence
  Description of Artificial Sequence: Synthetic peptide
EVKHLHHLL

SEQ ID NO: 675 - protein, 10 aa, Artificial Sequence
  Description of Artificial Sequence: Synthetic peptide
HLHHLLKQLK

SEQ ID NO: 676 - protein, 9 aa, Artificial Sequence
  Description of Artificial Sequence: Synthetic peptide
HLLLKRERV

SEQ ID NO: 677 - protein, 9 aa, Artificial Sequence
  Description of Artificial Sequence: Synthetic peptide
KIKHLLLKR

SEQ ID NO: 678 - protein, 9 aa, Artificial Sequence
  Description of Artificial Sequence: Synthetic peptide
KPSEKYLKI

SEQ ID NO: 679 - protein, 9 aa, Artificial Sequence
  Description of Artificial Sequence: Synthetic peptide
KYLKIKHLL

SEQ ID NO: 680 - protein, 10 aa, Artificial Sequence
  Description of Artificial Sequence: Synthetic peptide
KYLKIKHLLL

SEQ ID NO: 681 - protein, 10 aa, Artificial Sequence
  Description of Artificial Sequence: Synthetic peptide
LLKQLKPSEK

SEQ ID NO: 682 - protein, 9 aa, Artificial Sequence
  Description of Artificial Sequence: Synthetic peptide
LLKRERVDL

SEQ ID NO: 683 - protein, 10 aa, Artificial Sequence
  Description of Artificial Sequence: Synthetic peptide
LLLKRERVDL

SEQ ID NO: 684 - protein, 10 aa, Artificial Sequence
  Description of Artificial Sequence: Synthetic peptide
QLKPSEKYLK

SEQ ID NO: 685 - protein, 9 aa, Artificial Sequence
  Description of Artificial Sequence: Synthetic peptide
YLKIKHLLL

SEQ ID NO: 686 - protein, 10 aa, Artificial Sequence
  Description of Artificial Sequence: Synthetic peptide
YLKIKHLLLK

SEQ ID NO: 687 - protein, 9 aa, Artificial Sequence
  Description of Artificial Sequence: Synthetic peptide
ILPRKVLQM

SEQ ID NO: 688 - protein, 9 aa, Artificial Sequence
  Description of Artificial Sequence: Synthetic peptide
KVLQMDFLV

SEQ ID NO: 689 - protein, 10 aa, Artificial Sequence
  Description of Artificial Sequence: Synthetic peptide
LPRKVLQMDF

SEQ ID NO: 690 - protein, 10 aa, Artificial Sequence
  Description of Artificial Sequence: Synthetic peptide
LQMDFLVHPA

SEQ ID NO: 691 - protein, 9 aa, Artificial Sequence
  Description of Artificial Sequence: Synthetic peptide
QMDFLVHPA

SEQ ID NO: 692 - protein, 10 aa, Artificial Sequence
  Description of Artificial Sequence: Synthetic peptide
YILPRKVLQM

SEQ ID NO: 693 - protein, 10 aa, Artificial Sequence
  Description of Artificial Sequence: Synthetic peptide
APSPASRLQC

SEQ ID NO: 694 - protein, 10 aa, Artificial Sequence
  Description of Artificial Sequence: Synthetic peptide
HPLAPMPSKT

SEQ ID NO: 695 - protein, 9 aa, Artificial Sequence
  Description of Artificial Sequence: Synthetic peptide
ILPLPQLLL

SEQ ID NO: 696 - protein, 9 aa, Artificial Sequence
  Description of Artificial Sequence: Synthetic peptide
LLLSADQQA

SEQ ID NO: 697 - protein, 9 aa, Artificial Sequence
  Description of Artificial Sequence: Synthetic peptide
LPTQTRGCI

SEQ ID NO: 698 - protein, 10 aa, Artificial Sequence
  Description of Artificial Sequence: Synthetic peptide
LPTQTRGCIL

SEQ ID NO: 699 - protein, 10 aa, Artificial Sequence
  Description of Artificial Sequence: Synthetic peptide
RISCLPTQTR

SEQ ID NO: 700 - protein, 9 aa, Artificial Sequence
  Description of Artificial Sequence: Synthetic peptide
SLAETVSLH

SEQ ID NO: 701 - protein, 9 aa, Artificial Sequence
  Description of Artificial Sequence: Synthetic peptide
TPRSSSSSS

SEQ ID NO: 702 - protein, 10 aa, Artificial Sequence
  Description of Artificial Sequence: Synthetic peptide
TPRSSSSSSS

SEQ ID NO: 703 - protein, 9 aa, Artificial Sequence
  Description of Artificial Sequence: Synthetic peptide
ALPPVLLSL

SEQ ID NO: 704 - protein, 10 aa, Artificial Sequence
  Description of Artificial Sequence: Synthetic peptide
ALPPVLLSLA

SEQ ID NO: 705 - protein, 9 aa, Artificial Sequence
  Description of Artificial Sequence: Synthetic peptide
ALPRPLLAL

SEQ ID NO: 706 - protein, 9 aa, Artificial Sequence
  Description of Artificial Sequence: Synthetic peptide
ASRTASCIL

SEQ ID NO: 707 - protein, 10 aa, Artificial Sequence
  Description of Artificial Sequence: Synthetic peptide
EALPRPLLAL

SEQ ID NO: 708 - protein, 9 aa, Artificial Sequence
  Description of Artificial Sequence: Synthetic peptide
HLGHPVASR

SEQ ID NO: 709 - protein, 9 aa, Artificial Sequence
  Description of Artificial Sequence: Synthetic peptide
HPVASRTAS

SEQ ID NO: 710 - protein, 10 aa, Artificial Sequence
  Description of Artificial Sequence: Synthetic peptide
HPVASRTASC

SEQ ID NO: 711 - protein, 10 aa, Artificial Sequence
  Description of Artificial Sequence: Synthetic peptide
IIQLSLLSLL

SEQ ID NO: 712 - protein, 9 aa, Artificial Sequence
  Description of Artificial Sequence: Synthetic peptide
IQLSLLSLL

SEQ ID NO: 713 - protein, 10 aa, Artificial Sequence
  Description of Artificial Sequence: Synthetic peptide
IQLSLLSLLI

SEQ ID NO: 714 - protein, 9 aa, Artificial Sequence
  Description of Artificial Sequence: Synthetic peptide
LLALPPVLL

SEQ ID NO: 715 - protein, 9 aa, Artificial Sequence
  Description of Artificial Sequence: Synthetic peptide
LLIPPLTCL

SEQ ID NO: 716 - protein, 10 aa, Artificial Sequence
  Description of Artificial Sequence: Synthetic peptide
LLIPPLTCLA

SEQ ID NO: 717 - protein, 9 aa, Artificial Sequence
  Description of Artificial Sequence: Synthetic peptide
LLSLLIPPL

SEQ ID NO: 718 - protein, 10 aa, Artificial Sequence
  Description of Artificial Sequence: Synthetic peptide
LLSLLIPPLT

SEQ ID NO: 719 - protein, 10 aa, Artificial Sequence
  Description of Artificial Sequence: Synthetic peptide
LPRPLLALPP

SEQ ID NO: 720 - protein, 9 aa, Artificial Sequence
  Description of Artificial Sequence: Synthetic peptide
QLSLLSLLI

SEQ ID NO: 721 - protein, 9 aa, Artificial Sequence
  Description of Artificial Sequence: Synthetic peptide
RLLQCQATR

SEQ ID NO: 722 - protein, 9 aa, Artificial Sequence
  Description of Artificial Sequence: Synthetic peptide
RPLLALPPV

SEQ ID NO: 723 - protein, 10 aa, Artificial Sequence
  Description of Artificial Sequence: Synthetic peptide
RPLLALPPVL

SEQ ID NO: 724 - protein, 9 aa, Artificial Sequence
  Description of Artificial Sequence: Synthetic peptide
SLAQDHSRL

SEQ ID NO: 725 - protein, 10 aa, Artificial Sequence
  Description of Artificial Sequence: Synthetic peptide
SLAQDHSRLL

SEQ ID NO: 726 - protein, 10 aa, Artificial Sequence
  Description of Artificial Sequence: Synthetic peptide
SLLIPPLTCL

SEQ ID NO: 727 - protein, 9 aa, Artificial Sequence
  Description of Artificial Sequence: Synthetic peptide
SLLSLLIPP

SEQ ID NO: 728 - protein, 10 aa, Artificial Sequence
  Description of Artificial Sequence: Synthetic peptide
SLLSLLIPPL

SEQ ID NO: 729 - protein, 10 aa, Artificial Sequence
  Description of Artificial Sequence: Synthetic peptide
AAATSAASTL

SEQ ID NO: 730 - protein, 10 aa, Artificial Sequence
  Description of Artificial Sequence: Synthetic peptide
AAIPASTSAV

SEQ ID NO: 731 - protein, 9 aa, Artificial Sequence
  Description of Artificial Sequence: Synthetic peptide
AIPASTSAV

SEQ ID NO: 732 - protein, 10 aa, Artificial Sequence
  Description of Artificial Sequence: Synthetic peptide
ALPAGCVSSA

SEQ ID NO: 733 - protein, 10 aa, Artificial Sequence
  Description of Artificial Sequence: Synthetic peptide
APLLTATGSV

SEQ ID NO: 734 - protein, 9 aa, Artificial Sequence
  Description of Artificial Sequence: Synthetic peptide
APVLSASIL

SEQ ID NO: 735 - protein, 9 aa, Artificial Sequence
  Description of Artificial Sequence: Synthetic peptide
ATLLPATTV

SEQ ID NO: 736 - protein, 10 aa, Artificial Sequence
  Description of Artificial Sequence: Synthetic peptide
ATVSTTTAPV

SEQ ID NO: 737 - protein, 10 aa, Artificial Sequence
  Description of Artificial Sequence: Synthetic peptide
AVPANCLFPA

SEQ ID NO: 738 - protein, 10 aa, Artificial Sequence
  Description of Artificial Sequence: Synthetic peptide
CLFPAALPST

SEQ ID NO: 739 - protein, 9 aa, Artificial Sequence
  Description of Artificial Sequence: Synthetic peptide
CPTFVSAAA

SEQ ID NO: 740 - protein, 9 aa, Artificial Sequence
  Description of Artificial Sequence: Synthetic peptide
FPAALPSTA

SEQ ID NO: 741 - protein, 10 aa, Artificial Sequence
  Description of Artificial Sequence: Synthetic peptide
FPAALPSTAG

SEQ ID NO: 742 - protein, 9 aa, Artificial Sequence
  Description of Artificial Sequence: Synthetic peptide
GAECHGRPL

SEQ ID NO: 743 - protein, 9 aa, Artificial Sequence
  Description of Artificial Sequence: Synthetic peptide
GAISRFIWV

SEQ ID NO: 744 - protein, 10 aa, Artificial Sequence
  Description of Artificial Sequence: Synthetic peptide
ILPAAIPAST

SEQ ID NO: 745 - protein, 10 aa, Artificial Sequence
  Description of Artificial Sequence: Synthetic peptide
IWVSGILSPL

SEQ ID NO: 746 - protein, 10 aa, Artificial Sequence
  Description of Artificial Sequence: Synthetic peptide
LLTATGSVSL

SEQ ID NO: 747 - protein, 9 aa, Artificial Sequence
  Description of Artificial Sequence: Synthetic peptide
LLYTADSSL

SEQ ID NO: 748 - protein, 9 aa, Artificial Sequence
  Description of Artificial Sequence: Synthetic peptide
LPAAATSAA

SEQ ID NO: 749 - protein, 10 aa, Artificial Sequence
  Description of Artificial Sequence: Synthetic peptide
LPAAATSAAS

SEQ ID NO: 750 - protein, 9 aa, Artificial Sequence
  Description of Artificial Sequence: Synthetic peptide
LPAAIPAST

SEQ ID NO: 751 - protein, 9 aa, Artificial Sequence
  Description of Artificial Sequence: Synthetic peptide
LPAGCVSSA

SEQ ID NO: 752 - protein, 10 aa, Artificial Sequence
  Description of Artificial Sequence: Synthetic peptide
LPAGCVSSAP

SEQ ID NO: 753 - protein, 9 aa, Artificial Sequence
  Description of Artificial Sequence: Synthetic peptide
LYTADSSLW

SEQ ID NO: 754 - protein, 9 aa, Artificial Sequence
  Description of Artificial Sequence: Synthetic peptide
QPAKSSPSA

SEQ ID NO: 755 - protein, 10 aa, Artificial Sequence
  Description of Artificial Sequence: Synthetic peptide
QPAKSSPSAA

SEQ ID NO: 756 - protein, 9 aa, Artificial Sequence
  Description of Artificial Sequence: Synthetic peptide
RFIWVSGIL

SEQ ID NO: 757 - protein, 9 aa, Artificial Sequence
  Description of Artificial Sequence: Synthetic peptide
RPQRVWSTG

SEQ ID NO: 758 - protein, 10 aa, Artificial Sequence
  Description of Artificial Sequence: Synthetic peptide
RVWSTGPDSI

SEQ ID NO: 759 - protein, 9 aa, Artificial Sequence
  Description of Artificial Sequence: Synthetic peptide
SAVPGSIPL

SEQ ID NO: 760 - protein, 9 aa, Artificial Sequence
  Description of Artificial Sequence: Synthetic peptide
SILPAAIPA

SEQ ID NO: 761 - protein, 9 aa, Artificial Sequence
  Description of Artificial Sequence: Synthetic peptide
SLPAAATSA

SEQ ID NO: 762 - protein, 10 aa, Artificial Sequence
  Description of Artificial Sequence: Synthetic peptide
SLPAAATSAA

SEQ ID NO: 763 - protein, 9 aa, Artificial Sequence
  Description of Artificial Sequence: Synthetic peptide
SLWTTRPQR

SEQ ID NO: 764 - protein, 10 aa, Artificial Sequence
  Description of Artificial Sequence: Synthetic peptide
SLWTTRPQRV

SEQ ID NO: 765 - protein, 9 aa, Artificial Sequence
  Description of Artificial Sequence: Synthetic peptide
SPSAAAATL

SEQ ID NO: 766 - protein, 10 aa, Artificial Sequence
  Description of Artificial Sequence: Synthetic peptide
SPSAAAATLL

SEQ ID NO: 767 - protein, 10 aa, Artificial Sequence
  Description of Artificial Sequence: Synthetic peptide
TLDALPAGCV

SEQ ID NO: 768 - protein, 9 aa, Artificial Sequence
  Description of Artificial Sequence: Synthetic peptide
TVSTTTAPV

SEQ ID NO: 769 - protein, 9 aa, Artificial Sequence
  Description of Artificial Sequence: Synthetic peptide
VLSASILPA

SEQ ID NO: 770 - protein, 10 aa, Artificial Sequence
  Description of Artificial Sequence: Synthetic peptide
VLSASILPAA

SEQ ID NO: 771 - protein, 9 aa, Artificial Sequence
  Description of Artificial Sequence: Synthetic peptide
VPANCLFPA

SEQ ID NO: 772 - protein, 10 aa, Artificial Sequence
  Description of Artificial Sequence: Synthetic peptide
VPANCLFPAA

SEQ ID NO: 773 - protein, 9 aa, Artificial Sequence
  Description of Artificial Sequence: Synthetic peptide
VPDPSCPTF

SEQ ID NO: 774 - protein, 9 aa, Artificial Sequence
  Description of Artificial Sequence: Synthetic peptide
VPGSIPLPA

SEQ ID NO: 775 - protein, 10 aa, Artificial Sequence
  Description of Artificial Sequence: Synthetic peptide
VPGSIPLPAV

SEQ ID NO: 776 - protein, 9 aa, Artificial Sequence
  Description of Artificial Sequence: Synthetic peptide
WVSGILSPL

SEQ ID NO: 777 - protein, 10 aa, Artificial Sequence
  Description of Artificial Sequence: Synthetic peptide
YTADSSLWTT

SEQ ID NO: 778 - protein, 9 aa, Artificial Sequence
  Description of Artificial Sequence: Synthetic peptide
APAGMVNRA

SEQ ID NO: 779 - protein, 9 aa, Artificial Sequence
  Description of Artificial Sequence: Synthetic peptide
ASLHRRSYL

SEQ ID NO: 780 - protein, 10 aa, Artificial Sequence
  Description of Artificial Sequence: Synthetic peptide
ASLHRRSYLK

SEQ ID NO: 781 - protein, 10 aa, Artificial Sequence
  Description of Artificial Sequence: Synthetic peptide
FLLMDNKAPA

SEQ ID NO: 782 - protein, 9 aa, Artificial Sequence
  Description of Artificial Sequence: Synthetic peptide
HPRRSPSRL

SEQ ID NO: 783 - protein, 9 aa, Artificial Sequence
  Description of Artificial Sequence: Synthetic peptide
HPSLHISSP

SEQ ID NO: 784 - protein, 10 aa, Artificial Sequence
  Description of Artificial Sequence: Synthetic peptide
HRRSYLKIHL

SEQ ID NO: 785 - protein, 10 aa, Artificial Sequence
  Description of Artificial Sequence: Synthetic peptide
HSRFLLMDNK

SEQ ID NO: 786 - protein, 10 aa, Artificial Sequence
  Description of Artificial Sequence: Synthetic peptide
KLPIPSSASL

SEQ ID NO: 787 - protein, 10 aa, Artificial Sequence
  Description of Artificial Sequence: Synthetic peptide
KVLTLSSSSH

SEQ ID NO: 788 - protein, 9 aa, Artificial Sequence
  Description of Artificial Sequence: Synthetic peptide
LIHSRFLLM

SEQ ID NO: 789 - protein, 9 aa, Artificial Sequence
  Description of Artificial Sequence: Synthetic peptide
LLMDNKAPA

SEQ ID NO: 790 - protein, 10 aa, Artificial Sequence
  Description of Artificial Sequence: Synthetic peptide
LMDNKAPAGM

SEQ ID NO: 791 - protein, 9 aa, Artificial Sequence
  Description of Artificial Sequence: Synthetic peptide
LPIPSSASL

SEQ ID NO: 792 - protein, 9 aa, Artificial Sequence
  Description of Artificial Sequence: Synthetic peptide
MPNLRISSS

SEQ ID NO: 793 - protein, 10 aa, Artificial Sequence
  Description of Artificial Sequence: Synthetic peptide
MPNLRISSSH

SEQ ID NO: 794 - protein, 10 aa, Artificial Sequence
  Description of Artificial Sequence: Synthetic peptide
NLRISSSHSL

SEQ ID NO: 795 - protein, 10 aa, Artificial Sequence
  Description of Artificial Sequence: Synthetic peptide
PPTHSHRLSL

SEQ ID NO: 796 - protein, 10 aa, Artificial Sequence
  Description of Artificial Sequence: Synthetic peptide
RAGRRVPWAA

SEQ ID NO: 797 - protein, 10 aa, Artificial Sequence
  Description of Artificial Sequence: Synthetic peptide
RARLHITTSK

SEQ ID NO: 798 - protein, 10 aa, Artificial Sequence
  Description of Artificial Sequence: Synthetic peptide
RISSSHSLNH

SEQ ID NO: 799 - protein, 9 aa, Artificial Sequence
  Description of Artificial Sequence: Synthetic peptide
RLHTPPSSR

SEQ ID NO: 800 - protein, 10 aa, Artificial Sequence
  Description of Artificial Sequence: Synthetic peptide
RLHTPPSSRR

SEQ ID NO: 801 - protein, 9 aa, Artificial Sequence
  Description of Artificial Sequence: Synthetic peptide
RLRILSPSL

SEQ ID NO: 802 - protein, 9 aa, Artificial Sequence
  Description of Artificial Sequence: Synthetic peptide
RPLMPNLRI

SEQ ID NO: 803 - protein, 9 aa, Artificial Sequence
  Description of Artificial Sequence: Synthetic peptide
RPRPLMPNL

SEQ ID NO: 804 - protein, 10 aa, Artificial Sequence
  Description of Artificial Sequence: Synthetic peptide
SASLHRRSYL

SEQ ID NO: 805 - protein, 9 aa, Artificial Sequence
  Description of Artificial Sequence: Synthetic peptide
SLHISSPRL

SEQ ID NO: 806 - protein, 9 aa, Artificial Sequence
  Description of Artificial Sequence: Synthetic peptide
SLHRRSYLK

SEQ ID NO: 807 - protein, 10 aa, Artificial Sequence
  Description of Artificial Sequence: Synthetic peptide
SLHRRSYLKI

SEQ ID NO: 808 - protein, 9 aa, Artificial Sequence
  Description of Artificial Sequence: Synthetic peptide
SLIHSRFLL

SEQ ID NO: 809 - protein, 10 aa, Artificial Sequence
  Description of Artificial Sequence: Synthetic peptide
SLIHSRFLLM

SEQ ID NO: 810 - protein, 9 aa, Artificial Sequence
  Description of Artificial Sequence: Synthetic peptide
SLLTSSSNL

SEQ ID NO: 811 - protein, 10 aa, Artificial Sequence
  Description of Artificial Sequence: Synthetic peptide
SLNHHSSSPL

SEQ ID NO: 812 - protein, 10 aa, Artificial Sequence
  Description of Artificial Sequence: Synthetic peptide
SLSSPSKLPI

SEQ ID NO: 813 - protein, 9 aa, Artificial Sequence
  Description of Artificial Sequence: Synthetic peptide
SPLSLHTPS

SEQ ID NO: 814 - protein, 10 aa, Artificial Sequence
  Description of Artificial Sequence: Synthetic peptide
SPLSLHTPSS

SEQ ID NO: 815 - protein, 9 aa, Artificial Sequence
  Description of Artificial Sequence: Synthetic peptide
SPPTHSHRL

SEQ ID NO: 816 - protein, 9 aa, Artificial Sequence
  Description of Artificial Sequence: Synthetic peptide
SPRLHTPPS

SEQ ID NO: 817 - protein, 10 aa, Artificial Sequence
  Description of Artificial Sequence: Synthetic peptide
SPRLHTPPSS

SEQ ID NO: 818 - protein, 10 aa, Artificial Sequence
  Description of Artificial Sequence: Synthetic peptide
SPSLSSPSKL

SEQ ID NO: 819 - protein, 9 aa, Artificial Sequence
  Description of Artificial Sequence: Synthetic peptide
SYLKIHLGL

SEQ ID NO: 820 - protein, 10 aa, Artificial Sequence
  Description of Artificial Sequence: Synthetic peptide
TPSNHRPRPL

SEQ ID NO: 821 - protein, 10 aa, Artificial Sequence
  Description of Artificial Sequence: Synthetic peptide
TPSSHPSLHI

SEQ ID NO: 822 - protein, 10 aa, Artificial Sequence
  Description of Artificial Sequence: Synthetic peptide
CVPFWTGRIL

SEQ ID NO: 823 - protein, 11 aa, Artificial Sequence
  Description of Artificial Sequence: Synthetic peptide
HCVPFWTGRIL

SEQ ID NO: 824 - protein, 9 aa, Artificial Sequence
  Description of Artificial Sequence: Synthetic peptide
ILLPSAASV

SEQ ID NO: 825 - protein, 10 aa, Artificial Sequence
  Description of Artificial Sequence: Synthetic peptide
ILLPSAASVC

SEQ ID NO: 826 - protein, 11 aa, Artificial Sequence
  Description of Artificial Sequence: Synthetic peptide
LLPSAASVCPI

SEQ ID NO: 827 - protein, 10 aa, Artificial Sequence
  Description of Artificial Sequence: Synthetic peptide
LPSAASVCPI

SEQ ID NO: 828 - protein, 8 aa, Artificial Sequence
  Description of Artificial Sequence: Synthetic peptide
MRPHCVPF

SEQ ID NO: 829 - protein, 10 aa, Artificial Sequence
  Description of Artificial Sequence: Synthetic peptide
RILLPSAASV

SEQ ID NO: 830 - protein, 9 aa, Artificial Sequence
  Description of Artificial Sequence: Synthetic peptide
RMRPHCVPF

SEQ ID NO: 831 - protein, 10 aa, Artificial Sequence
  Description of Artificial Sequence: Synthetic peptide
RMRPHCVPFW

SEQ ID NO: 832 - protein, 9 aa, Artificial Sequence
  Description of Artificial Sequence: Synthetic peptide
RTNPTVRMR

SEQ ID NO: 833 - protein, 9 aa, Artificial Sequence
  Description of Artificial Sequence: Synthetic peptide
SVCPIPFEA

SEQ ID NO: 834 - protein, 9 aa, Artificial Sequence
  Description of Artificial Sequence: Synthetic peptide
TVRMRPHCV

SEQ ID NO: 835 - protein, 11 aa, Artificial Sequence
  Description of Artificial Sequence: Synthetic peptide
TVRMRPHCVPF

SEQ ID NO: 836 - protein, 9 aa, Artificial Sequence
  Description of Artificial Sequence: Synthetic peptide
VPFWTGRIL

SEQ ID NO: 837 - protein, 10 aa, Artificial Sequence
  Description of Artificial Sequence: Synthetic peptide
VPFWTGRILL

SEQ ID NO: 838 - protein, 10 aa, Artificial Sequence
  Description of Artificial Sequence: Synthetic peptide
VRMRPHCVPF

SEQ ID NO: 839 - protein, 9 aa, Artificial Sequence
  Description of Artificial Sequence: Synthetic peptide
AMVPRGVSM

SEQ ID NO: 840 - protein, 10 aa, Artificial Sequence
  Description of Artificial Sequence: Synthetic peptide
AMVPRGVSMA

SEQ ID NO: 841 - protein, 10 aa, Artificial Sequence
  Description of Artificial Sequence: Synthetic peptide
AWAPTSRTPW

SEQ ID NO: 842 - protein, 10 aa, Artificial Sequence
  Description of Artificial Sequence: Synthetic peptide
CPMPTTPVQA

SEQ ID NO: 843 - protein, 10 aa, Artificial Sequence
  Description of Artificial Sequence: Synthetic peptide
CPSTVPPSPA

SEQ ID NO: 844 - protein, 10 aa, Artificial Sequence
  Description of Artificial Sequence: Synthetic peptide
GAMVPRGVSM

SEQ ID NO: 845 - protein, 10 aa, Artificial Sequence
  Description of Artificial Sequence: Synthetic peptide
MPCPMPTTPV

SEQ ID NO: 846 - protein, 9 aa, Artificial Sequence
  Description of Artificial Sequence: Synthetic peptide
MPTTPVQAW

SEQ ID NO: 847 - protein, 10 aa, Artificial Sequence
  Description of Artificial Sequence: Synthetic peptide
MPTTPVQAWL

SEQ ID NO: 848 - protein, 10 aa, Artificial Sequence
  Description of Artificial Sequence: Synthetic peptide
SLPEDRYTQA

SEQ ID NO: 849 - protein, 9 aa, Artificial Sequence
  Description of Artificial Sequence: Synthetic peptide
SPAQPYLRV

SEQ ID NO: 850 - protein, 10 aa, Artificial Sequence
  Description of Artificial Sequence: Synthetic peptide
SPAQPYLRVS

SEQ ID NO: 851 - protein, 9 aa, Artificial Sequence
  Description of Artificial Sequence: Synthetic peptide
TIMPCPMPT

SEQ ID NO: 852 - protein, 9 aa, Artificial Sequence
  Description of Artificial Sequence: Synthetic peptide
TPVQAWLEA

SEQ ID NO: 853 - protein, 9 aa, Artificial Sequence
  Description of Artificial Sequence: Synthetic peptide
TSRTPWGAM

SEQ ID NO: 854 - protein, 10 aa, Artificial Sequence
  Description of Artificial Sequence: Synthetic peptide
VPPSPAQPYL

SEQ ID NO: 855 - protein, 9 aa, Artificial Sequence
  Description of Artificial Sequence: Synthetic peptide
VPRGVSMAH

SEQ ID NO: 856 - protein, 10 aa, Artificial Sequence
  Description of Artificial Sequence: Synthetic peptide
CLSARTGLSI

SEQ ID NO: 857 - protein, 10 aa, Artificial Sequence
  Description of Artificial Sequence: Synthetic peptide
CTTLNSPPLK

SEQ ID NO: 858 - protein, 9 aa, Artificial Sequence
  Description of Artificial Sequence: Synthetic peptide
GLSISCTTL

SEQ ID NO: 859 - protein, 9 aa, Artificial Sequence
  Description of Artificial Sequence: Synthetic peptide
SPPLKKMSM

SEQ ID NO: 860 - protein, 9 aa, Artificial Sequence
  Description of Artificial Sequence: Synthetic peptide
TLNSPPLKK

SEQ ID NO: 861 - protein, 9 aa, Artificial Sequence
  Description of Artificial Sequence: Synthetic peptide
TTLNSPPLK

SEQ ID NO: 862 - protein, 10 aa, Artificial Sequence
  Description of Artificial Sequence: Synthetic peptide
TTLNSPPLKK

SEQ ID NO: 863 - protein, 9 aa, Artificial Sequence
  Description of Artificial Sequence: Synthetic peptide
LQRFRFTHV

SEQ ID NO: 864 - protein, 10 aa, Artificial Sequence
  Description of Artificial Sequence: Synthetic peptide
LQRFRFTHVI

SEQ ID NO: 865 - protein, 9 aa, Artificial Sequence
  Description of Artificial Sequence: Synthetic peptide
RLSSVLQRF

SEQ ID NO: 866 - protein, 10 aa, Artificial Sequence
  Description of Artificial Sequence: Synthetic peptide
RLSSVLQRFR

SEQ ID NO: 867 - protein, 10 aa, Artificial Sequence
  Description of Artificial Sequence: Synthetic peptide
VLQRFRFTHV

SEQ ID NO: 868 - protein, 10 aa, Artificial Sequence
  Description of Artificial Sequence: Synthetic peptide
ASVGRHSLSK

SEQ ID NO: 869 - protein, 9 aa, Artificial Sequence
  Description of Artificial Sequence: Synthetic peptide
KFLPFWGFL

SEQ ID NO: 870 - protein, 9 aa, Artificial Sequence
  Description of Artificial Sequence: Synthetic peptide
LASVGRHSL

SEQ ID NO: 871 - protein, 10 aa, Artificial Sequence
  Description of Artificial Sequence: Synthetic peptide
LPFWGFLEEF

SEQ ID NO: 872 - protein, 9 aa, Artificial Sequence
  Description of Artificial Sequence: Synthetic peptide
PFWGFLEEF

SEQ ID NO: 873 - protein, 9 aa, Artificial Sequence
  Description of Artificial Sequence: Synthetic peptide
SVGRHSLSK

SEQ ID NO: 874 - protein, 9 aa, Artificial Sequence
  Description of Artificial Sequence: Synthetic peptide
APRPIRPPF

SEQ ID NO: 875 - protein, 10 aa, Artificial Sequence
  Description of Artificial Sequence: Synthetic peptide
APRPIRPPFL

SEQ ID NO: 876 - protein, 10 aa, Artificial Sequence
  Description of Artificial Sequence: Synthetic peptide
AQKMKKAHFL

SEQ ID NO: 877 - protein, 9 aa, Artificial Sequence
  Description of Artificial Sequence: Synthetic peptide
FLPSAAQKM

SEQ ID NO: 878 - protein, 10 aa, Artificial Sequence
  Description of Artificial Sequence: Synthetic peptide
GLFLPSAAQK

SEQ ID NO: 879 - protein, 9 aa, Artificial Sequence
  Description of Artificial Sequence: Synthetic peptide
HPLLVSLLL

SEQ ID NO: 880 - protein, 10 aa, Artificial Sequence
  Description of Artificial Sequence: Synthetic peptide
KAHFLKTWFR

SEQ ID NO: 881 - protein, 9 aa, Artificial Sequence
  Description of Artificial Sequence: Synthetic peptide
KARFSTASL

SEQ ID NO: 882 - protein, 9 aa, Artificial Sequence
  Description of Artificial Sequence: Synthetic peptide
KMKKAHFLK

SEQ ID NO: 883 - protein, 10 aa, Artificial Sequence
  Description of Artificial Sequence: Synthetic peptide
KTWFRSNPTK

SEQ ID NO: 884 - protein, 9 aa, Artificial Sequence
  Description of Artificial Sequence: Synthetic peptide
LAKELTHPL

SEQ ID NO: 885 - protein, 10 aa, Artificial Sequence
  Description of Artificial Sequence: Synthetic peptide
LAKELTHPLL

SEQ ID NO: 886 - protein, 10 aa, Artificial Sequence
  Description of Artificial Sequence: Synthetic peptide
NPTKTKKARF

SEQ ID NO: 887 - protein, 9 aa, Artificial Sequence
  Description of Artificial Sequence: Synthetic peptide
QKMKKAHFL

SEQ ID NO: 888 - protein, 9 aa, Artificial Sequence
  Description of Artificial Sequence: Synthetic peptide
RFSTASLAK

SEQ ID NO: 889 - protein, 10 aa, Artificial Sequence
  Description of Artificial Sequence: Synthetic peptide
RPIRPPFLES

SEQ ID NO: 890 - protein, 9 aa, Artificial Sequence
  Description of Artificial Sequence: Synthetic peptide
RSNPTKTKK

SEQ ID NO: 891 - protein, 10 aa, Artificial Sequence
  Description of Artificial Sequence: Synthetic peptide
SLAKELTHPL

SEQ ID NO: 892 - protein, 9 aa, Artificial Sequence
  Description of Artificial Sequence: Synthetic peptide
TKKARFSTA

SEQ ID NO: 893 - protein, 9 aa, Artificial Sequence
  Description of Artificial Sequence: Synthetic peptide
GLRFWNPSR

SEQ ID NO: 894 - protein, 10 aa, Artificial Sequence
  Description of Artificial Sequence: Synthetic peptide
ISQLLSWPQK

SEQ ID NO: 895 - protein, 9 aa, Artificial Sequence
  Description of Artificial Sequence: Synthetic peptide
RIAHISQLL

SEQ ID NO: 896 - protein, 9 aa, Artificial Sequence
  Description of Artificial Sequence: Synthetic peptide
RLGYSSHQL

SEQ ID NO: 897 - protein, 9 aa, Artificial Sequence
  Description of Artificial Sequence: Synthetic peptide
SQLLSWPQK

SEQ ID NO: 898 - protein, 9 aa, Artificial Sequence
  Description of Artificial Sequence: Synthetic peptide
SRIAHISQL

SEQ ID NO: 899 - protein, 9 aa, Artificial Sequence
  Description of Artificial Sequence: Synthetic peptide
WPQKTEERL

SEQ ID NO: 900 - protein, 9 aa, Artificial Sequence
  Description of Artificial Sequence: Synthetic peptide
YSSHQLPRK

SEQ ID NO: 901 - protein, 10 aa, Artificial Sequence
  Description of Artificial Sequence: Synthetic peptide
CPQRMTPGTT

SEQ ID NO: 902 - protein, 9 aa, Artificial Sequence
  Description of Artificial Sequence: Synthetic peptide
EAEKRTRTL

SEQ ID NO: 903 - protein, 9 aa, Artificial Sequence
  Description of Artificial Sequence: Synthetic peptide
GTTFITMMK

SEQ ID NO: 904 - protein, 10 aa, Artificial Sequence
  Description of Artificial Sequence: Synthetic peptide
GTTFITMMKK

SEQ ID NO: 905 - protein, 10 aa, Artificial Sequence
  Description of Artificial Sequence: Synthetic peptide
ITMMKKEAEK

SEQ ID NO: 906 - protein, 9 aa, Artificial Sequence
  Description of Artificial Sequence: Synthetic peptide
RMTPGTTFI

SEQ ID NO: 907 - protein, 9 aa, Artificial Sequence
  Description of Artificial Sequence: Synthetic peptide
SPYCPQRMT

SEQ ID NO: 908 - protein, 9 aa, Artificial Sequence
  Description of Artificial Sequence: Synthetic peptide
TMMKKEAEK

SEQ ID NO: 909 - protein, 9 aa, Artificial Sequence
  Description of Artificial Sequence: Synthetic peptide
TPGTTFITM

SEQ ID NO: 910 - protein, 10 aa, Artificial Sequence
  Description of Artificial Sequence: Synthetic peptide
TPGTTFITMM

SEQ ID NO: 911 - protein, 9 aa, Artificial Sequence
  Description of Artificial Sequence: Synthetic peptide
TTFITMMKK

SEQ ID NO: 912 - protein, 9 aa, Artificial Sequence
  Description of Artificial Sequence: Synthetic peptide
CPGATWREA

SEQ ID NO: 913 - protein, 10 aa, Artificial Sequence
  Description of Artificial Sequence: Synthetic peptide
CPGATWREAA

SEQ ID NO: 914 - protein, 10 aa, Artificial Sequence
  Description of Artificial Sequence: Synthetic peptide
RSRCPGATWR

SEQ ID NO: 915 - protein, 9 aa, Artificial Sequence
  Description of Artificial Sequence: Synthetic peptide
TPRATRSRC

SEQ ID NO: 916 - protein, 10 aa, Artificial Sequence
  Description of Artificial Sequence: Synthetic peptide
HVLPEPHLAL

SEQ ID NO: 917 - protein, 10 aa, Artificial Sequence
  Description of Artificial Sequence: Synthetic peptide
RPLQTHVLPE

SEQ ID NO: 918 - protein, 10 aa, Artificial Sequence
  Description of Artificial Sequence: Synthetic peptide
VLWTTPPLQH

SEQ ID NO: 919 - protein, 10 aa, Artificial Sequence
  Description of Artificial Sequence: Synthetic peptide
APSESPCSPF

SEQ ID NO: 920 - protein, 10 aa, Artificial Sequence
  Description of Artificial Sequence: Synthetic peptide
CPLDHTTPPA

SEQ ID NO: 921 - protein, 9 aa, Artificial Sequence
  Description of Artificial Sequence: Synthetic peptide
FLQEQYHEA

SEQ ID NO: 922 - protein, 10 aa, Artificial Sequence
  Description of Artificial Sequence: Synthetic peptide
RLAFLQEQYH

SEQ ID NO: 923 - protein, 10 aa, Artificial Sequence
  Description of Artificial Sequence: Synthetic peptide
SPCSPFRLAF

SEQ ID NO: 924 - protein, 9 aa, Artificial Sequence
  Description of Artificial Sequence: Synthetic peptide
SPPWVRALL

SEQ ID NO: 925 - protein, 10 aa, Artificial Sequence
  Description of Artificial Sequence: Synthetic peptide
YPACPLDHTT

SEQ ID NO: 926 - protein, 9 aa, Artificial Sequence
  Description of Artificial Sequence: Synthetic peptide
ALHLRSCPC

SEQ ID NO: 927 - protein, 9 aa, Artificial Sequence
  Description of Artificial Sequence: Synthetic peptide
CLHHRRHLV

SEQ ID NO: 928 - protein, 10 aa, Artificial Sequence
  Description of Artificial Sequence: Synthetic peptide
CLHHRRHLVC

SEQ ID NO: 929 - protein, 10 aa, Artificial Sequence
  Description of Artificial Sequence: Synthetic peptide
CLHRKSHPHL

SEQ ID NO: 930 - protein, 9 aa, Artificial Sequence
  Description of Artificial Sequence: Synthetic peptide
CLRSHACPP

SEQ ID NO: 931 - protein, 9 aa, Artificial Sequence
  Description of Artificial Sequence: Synthetic peptide
CLRSHTCPP

SEQ ID NO: 932 - protein, 9 aa, Artificial Sequence
  Description of Artificial Sequence: Synthetic peptide
CLWCHACLH

SEQ ID NO: 933 - protein, 9 aa, Artificial Sequence
  Description of Artificial Sequence: Synthetic peptide
CPHHLKNHL

SEQ ID NO: 934 - protein, 9 aa, Artificial Sequence
  Description of Artificial Sequence: Synthetic peptide
CPHHLKNLL

SEQ ID NO: 935 - protein, 9 aa, Artificial Sequence
  Description of Artificial Sequence: Synthetic peptide
CPHHLRTRL

SEQ ID NO: 936 - protein, 10 aa, Artificial Sequence
  Description of Artificial Sequence: Synthetic peptide
CPLHLRSLPF

SEQ ID NO: 937 - protein, 10 aa, Artificial Sequence
  Description of Artificial Sequence: Synthetic peptide
CPLPRHLKHL

SEQ ID NO: 938 - protein, 10 aa, Artificial Sequence
  Description of Artificial Sequence: Synthetic peptide
CPLSLRSHPC

SEQ ID NO: 939 - protein, 10 aa, Artificial Sequence
  Description of Artificial Sequence: Synthetic peptide
CPRHLRNCPL

SEQ ID NO: 940 - protein, 9 aa, Artificial Sequence
  Description of Artificial Sequence: Synthetic peptide
FPHHLRHHA

SEQ ID NO: 941 - protein, 10 aa, Artificial Sequence
  Description of Artificial Sequence: Synthetic peptide
FPHHLRHHAC

SEQ ID NO: 942 - protein, 9 aa, Artificial Sequence
  Description of Artificial Sequence: Synthetic peptide
GLRSRTCPP

SEQ ID NO: 943 - protein, 10 aa, Artificial Sequence
  Description of Artificial Sequence: Synthetic peptide
HACLHRLRNL

SEQ ID NO: 944 - protein, 9 aa, Artificial Sequence
  Description of Artificial Sequence: Synthetic peptide
HLACLHHLR

SEQ ID NO: 945 - protein, 9 aa, Artificial Sequence
  Description of Artificial Sequence: Synthetic peptide
HLCPPHLRY

SEQ ID NO: 946 - protein, 10 aa, Artificial Sequence
  Description of Artificial Sequence: Synthetic peptide
HLCPPHLRYR

SEQ ID NO: 947 - protein, 9 aa, Artificial Sequence
  Description of Artificial Sequence: Synthetic peptide
HLKHLACLH

SEQ ID NO: 948 - protein, 9 aa, Artificial Sequence
  Description of Artificial Sequence: Synthetic peptide
HLKHRPCPH

SEQ ID NO: 949 - protein, 9 aa, Artificial Sequence
  Description of Artificial Sequence: Synthetic peptide
HLKNHLCPP

SEQ ID NO: 950 - protein, 9 aa, Artificial Sequence
  Description of Artificial Sequence: Synthetic peptide
HLKSHPCLH

SEQ ID NO: 951 - protein, 9 aa, Artificial Sequence
  Description of Artificial Sequence: Synthetic peptide
HLKSLLCPL

SEQ ID NO: 952 - protein, 9 aa, Artificial Sequence
  Description of Artificial Sequence: Synthetic peptide
HLLHLRRLY

SEQ ID NO: 953 - protein, 9 aa, Artificial Sequence
  Description of Artificial Sequence: Synthetic peptide
HLRNCPLPR

SEQ ID NO: 954 - protein, 10 aa, Artificial Sequence
  Description of Artificial Sequence: Synthetic peptide
HLRNCPLPRH

SEQ ID NO: 955 - protein, 10 aa, Artificial Sequence
  Description of Artificial Sequence: Synthetic peptide
HLRRLYPHHL

SEQ ID NO: 956 - protein, 9 aa, Artificial Sequence
  Description of Artificial Sequence: Synthetic peptide
HLRSHPCPL

SEQ ID NO: 957 - protein, 10 aa, Artificial Sequence
  Description of Artificial Sequence: Synthetic peptide
HLRSHPCPLH

SEQ ID NO: 958 - protein, 9 aa, Artificial Sequence
  Description of Artificial Sequence: Synthetic peptide
HLRSLPFPH

SEQ ID NO: 959 - protein, 9 aa, Artificial Sequence
  Description of Artificial Sequence: Synthetic peptide
HLRTRLCPH

SEQ ID NO: 960 - protein, 9 aa, Artificial Sequence
  Description of Artificial Sequence: Synthetic peptide
HLVCSHHLK

SEQ ID NO: 961 - protein, 10 aa, Artificial Sequence
  Description of Artificial Sequence: Synthetic peptide
HPCLHHRRHL

SEQ ID NO: 962 - protein, 9 aa, Artificial Sequence
  Description of Artificial Sequence: Synthetic peptide
HPGLRSRTC

SEQ ID NO: 963 - protein, 10 aa, Artificial Sequence
  Description of Artificial Sequence: Synthetic peptide
HPHLLHLRRL

SEQ ID NO: 964 - protein, 9 aa, Artificial Sequence
  Description of Artificial Sequence: Synthetic peptide
HRKSHPHLL

SEQ ID NO: 965 - protein, 9 aa, Artificial Sequence
  Description of Artificial Sequence: Synthetic peptide
HRRTRSCPC

SEQ ID NO: 966 - protein, 10 aa, Artificial Sequence
  Description of Artificial Sequence: Synthetic peptide
KSHPHLLHLR

SEQ ID NO: 967 - protein, 10 aa, Artificial Sequence
  Description of Artificial Sequence: Synthetic peptide
KSLLCPLHLR

SEQ ID NO: 968 - protein, 10 aa, Artificial Sequence
  Description of Artificial Sequence: Synthetic peptide
LLCPLHLRSL

SEQ ID NO: 969 - protein, 10 aa, Artificial Sequence
  Description of Artificial Sequence: Synthetic peptide
LLHLRRLYPH

SEQ ID NO: 970 - protein, 9 aa, Artificial Sequence
  Description of Artificial Sequence: Synthetic peptide
LPRHLKHLA

SEQ ID NO: 971 - protein, 10 aa, Artificial Sequence
  Description of Artificial Sequence: Synthetic peptide
LPRHLKHLAC

SEQ ID NO: 972 - protein, 9 aa, Artificial Sequence
  Description of Artificial Sequence: Synthetic peptide
LRRLRSHTC

SEQ ID NO: 973 - protein, 9 aa, Artificial Sequence
  Description of Artificial Sequence: Synthetic peptide
LRRLYPHHL

SEQ ID NO: 974 - protein, 10 aa, Artificial Sequence
  Description of Artificial Sequence: Synthetic peptide
LVCSHHLKSL

SEQ ID NO: 975 - protein, 10 aa, Artificial Sequence
  Description of Artificial Sequence: Synthetic peptide
NLRNHTCPPS

SEQ ID NO: 976 - protein, 9 aa, Artificial Sequence
  Description of Artificial Sequence: Synthetic peptide
PLHLRSLPF

SEQ ID NO: 977 - protein, 10 aa, Artificial Sequence
  Description of Artificial Sequence: Synthetic peptide
RLCPHHLKNH

SEQ ID NO: 978 - protein, 9 aa, Artificial Sequence
  Description of Artificial Sequence: Synthetic peptide
RLYPHHLKH

SEQ ID NO: 979 - protein, 10 aa, Artificial Sequence
  Description of Artificial Sequence: Synthetic peptide
RLYPHHLKHR

SEQ ID NO: 980 - protein, 10 aa, Artificial Sequence
  Description of Artificial Sequence: Synthetic peptide
RPCPHHLKNL

SEQ ID NO: 981 - protein, 10 aa, Artificial Sequence
  Description of Artificial Sequence: Synthetic peptide
RSHPCPLHLK

SEQ ID NO: 982 - protein, 10 aa, Artificial Sequence
  Description of Artificial Sequence: Synthetic peptide
RSLPFPHHLR

SEQ ID NO: 983 - protein, 9 aa, Artificial Sequence
  Description of Artificial Sequence: Synthetic peptide
RTRLCPHHL

SEQ ID NO: 984 - protein, 10 aa, Artificial Sequence
  Description of Artificial Sequence: Synthetic peptide
RTRLCPHHLK

SEQ ID NO: 985 - protein, 9 aa, Artificial Sequence
  Description of Artificial Sequence: Synthetic peptide
SLLCPLHLR

SEQ ID NO: 986 - protein, 9 aa, Artificial Sequence
  Description of Artificial Sequence: Synthetic peptide
SLRSHACPP

SEQ ID NO: 987 - protein, 9 aa, Artificial Sequence
  Description of Artificial Sequence: Synthetic peptide
SPLRSQANA

SEQ ID NO: 988 - protein, 9 aa, Artificial Sequence
  Description of Artificial Sequence: Synthetic peptide
YLRRLRSHT

SEQ ID NO: 989 - protein, 10 aa, Artificial Sequence
  Description of Artificial Sequence: Synthetic peptide
YPHHLKHRPC

SEQ ID NO: 990 - protein, 9 aa, Artificial Sequence
  Description of Artificial Sequence: Synthetic peptide
FITSGQIFK

SEQ ID NO: 991 - protein, 9 aa, Artificial Sequence
  Description of Artificial Sequence: Synthetic peptide
IFITSGQIF

SEQ ID NO: 992 - protein, 9 aa, Artificial Sequence
  Description of Artificial Sequence: Synthetic peptide
SQSEALCVL

SEQ ID NO: 993 - protein, 10 aa, Artificial Sequence
  Description of Artificial Sequence: Synthetic peptide
SQSEALCVLL

SEQ ID NO: 994 - protein, 9 aa, Artificial Sequence
  Description of Artificial Sequence: Synthetic peptide
AYTGTILMM

SEQ ID NO: 995 - protein, 10 aa, Artificial Sequence
  Description of Artificial Sequence: Synthetic peptide
DLKAYTGTIL

SEQ ID NO: 996 - protein, 9 aa, Artificial Sequence
  Description of Artificial Sequence: Synthetic peptide
ILTKQIKTK

SEQ ID NO: 997 - protein, 9 aa, Artificial Sequence
  Description of Artificial Sequence: Synthetic peptide
KMILTKQIK

SEQ ID NO: 998 - protein, 9 aa, Artificial Sequence
  Description of Artificial Sequence: Synthetic peptide
KPTDTFLQI

SEQ ID NO: 999 - protein, 10 aa, Artificial Sequence
  Description of Artificial Sequence: Synthetic peptide
KPTDTFLQIL

SEQ ID NO: 1000 - protein, 10 aa, Artificial Sequence
  Description of Artificial Sequence: Synthetic peptide
MILTKQIKTK

SEQ ID NO: 1001 - protein, 10 aa, Artificial Sequence
  Description of Artificial Sequence: Synthetic peptide
ITRYTIFVLK

SEQ ID NO: 1002 - protein, 9 aa, Artificial Sequence
  Description of Artificial Sequence: Synthetic peptide
LIAELHNIL

SEQ ID NO: 1003 - protein, 10 aa, Artificial Sequence
  Description of Artificial Sequence: Synthetic peptide
LIAELHNILL

SEQ ID NO: 1004 - protein, 10 aa, Artificial Sequence
  Description of Artificial Sequence: Synthetic peptide
MTPPNLIAEL

SEQ ID NO: 1005 - protein, 9 aa, Artificial Sequence
  Description of Artificial Sequence: Synthetic peptide
NLIAELHNI

SEQ ID NO: 1006 - protein, 10 aa, Artificial Sequence
  Description of Artificial Sequence: Synthetic peptide
NLIAELHNIL

SEQ ID NO: 1007 - protein, 10 aa, Artificial Sequence
  Description of Artificial Sequence: Synthetic peptide
RYTIFVLKDI

SEQ ID NO: 1008 - protein, 10 aa, Artificial Sequence
  Description of Artificial Sequence: Synthetic peptide
TITRYTIFVL

SEQ ID NO: 1009 - protein, 9 aa, Artificial Sequence
  Description of Artificial Sequence: Synthetic peptide
TPPNLIAEL

SEQ ID NO: 1010 - protein, 9 aa, Artificial Sequence
  Description of Artificial Sequence: Synthetic peptide
FLQFRTHTT

SEQ ID NO: 1011 - protein, 10 aa, Artificial Sequence
  Description of Artificial Sequence: Synthetic peptide
LPAKGEDIFL

SEQ ID NO: 1012 - protein, 10 aa, Artificial Sequence
  Description of Artificial Sequence: Synthetic peptide
LQFRTHTTGR

SEQ ID NO: 1013 - protein, 9 aa, Artificial Sequence
  Description of Artificial Sequence: Synthetic peptide
NLQSSVCGL

SEQ ID NO: 1014 - protein, 9 aa, Artificial Sequence
  Description of Artificial Sequence: Synthetic peptide
SSVCGLPAK

SEQ ID NO: 1015 - protein, 10 aa, Artificial Sequence
  Description of Artificial Sequence: Synthetic peptide
VQWRNLQSSV

SEQ ID NO: 1016 - protein, 9 aa, Artificial Sequence
  Description of Artificial Sequence: Synthetic peptide
GQNVSLLGK

SEQ ID NO: 1017 - protein, 10 aa, Artificial Sequence
  Description of Artificial Sequence: Synthetic peptide
HTRTRGNLRK

SEQ ID NO: 1018 - protein, 10 aa, Artificial Sequence
  Description of Artificial Sequence: Synthetic peptide
ILHTRTRGNL

SEQ ID NO: 1019 - protein, 10 aa, Artificial Sequence
  Description of Artificial Sequence: Synthetic peptide
KGQNVSLLGK

SEQ ID NO: 1020 - protein, 9 aa, Artificial Sequence
  Description of Artificial Sequence: Synthetic peptide
LLGKYILHT

SEQ ID NO: 1021 - protein, 10 aa, Artificial Sequence
  Description of Artificial Sequence: Synthetic peptide
LRKSRKWKSM

SEQ ID NO: 1022 - protein, 9 aa, Artificial Sequence
  Description of Artificial Sequence: Synthetic peptide
SLLGKYILH

SEQ ID NO: 1023 - protein, 10 aa, Artificial Sequence
  Description of Artificial Sequence: Synthetic peptide
SLLGKYILHT

SEQ ID NO: 1024 - protein, 9 aa, Artificial Sequence
  Description of Artificial Sequence: Synthetic peptide
CTSPLLAPV

SEQ ID NO: 1025 - protein, 9 aa, Artificial Sequence
  Description of Artificial Sequence: Synthetic peptide
FPENLPGQL

SEQ ID NO: 1026 - protein, 10 aa, Artificial Sequence
  Description of Artificial Sequence: Synthetic peptide
GLLAFWDSQV

SEQ ID NO: 1027 - protein, 9 aa, Artificial Sequence
  Description of Artificial Sequence: Synthetic peptide
IFCPFPENL

SEQ ID NO: 1028 - protein, 9 aa, Artificial Sequence
  Description of Artificial Sequence: Synthetic peptide
LLAFWDSQV

SEQ ID NO: 1029 - protein, 9 aa, Artificial Sequence
  Description of Artificial Sequence: Synthetic peptide
LLAPVIFCP

SEQ ID NO: 1030 - protein, 10 aa, Artificial Sequence
  Description of Artificial Sequence: Synthetic peptide
LLAPVIFCPF

SEQ ID NO: 1031 - protein, 9 aa, Artificial Sequence
  Description of Artificial Sequence: Synthetic peptide
LPCPQQDVL

SEQ ID NO: 1032 - protein, 9 aa, Artificial Sequence
  Description of Artificial Sequence: Synthetic peptide
RFPSGLLAF

SEQ ID NO: 1033 - protein, 10 aa, Artificial Sequence
  Description of Artificial Sequence: Synthetic peptide
RFPSGLLAFW

SEQ ID NO: 1034 - protein, 9 aa, Artificial Sequence
  Description of Artificial Sequence: Synthetic peptide
SPLLAPVIF

SEQ ID NO: 1035 - protein, 9 aa, Artificial Sequence
  Description of Artificial Sequence: Synthetic peptide
SPRGPCTSS

SEQ ID NO: 1036 - protein, 10 aa, Artificial Sequence
  Description of Artificial Sequence: Synthetic peptide
SPRGPCTSSS

SEQ ID NO: 1037 - protein, 9 aa, Artificial Sequence
  Description of Artificial Sequence: Synthetic peptide
SQVCDLHVL

SEQ ID NO: 1038 - protein, 10 aa, Artificial Sequence
  Description of Artificial Sequence: Synthetic peptide
VIFCPFPENL

SEQ ID NO: 1039 - protein, 9 aa, Artificial Sequence
  Description of Artificial Sequence: Synthetic peptide
AMVWPLLSI

SEQ ID NO: 1040 - protein, 10 aa, Artificial Sequence
  Description of Artificial Sequence: Synthetic peptide
AMVWPLLSIL

SEQ ID NO: 1041 - protein, 9 aa, Artificial Sequence
  Description of Artificial Sequence: Synthetic peptide
AQIAMVWPL

SEQ ID NO: 1042 - protein, 10 aa, Artificial Sequence
  Description of Artificial Sequence: Synthetic peptide
AQIAMVWPLL

SEQ ID NO: 1043 - protein, 9 aa, Artificial Sequence
  Description of Artificial Sequence: Synthetic peptide
CPMSRLRLA

SEQ ID NO: 1044 - protein, 10 aa, Artificial Sequence
  Description of Artificial Sequence: Synthetic peptide
CPMSRLRLAL

SEQ ID NO: 1045 - protein, 10 aa, Artificial Sequence
  Description of Artificial Sequence: Synthetic peptide
IAMVWPLLSI

SEQ ID NO: 1046 - protein, 10 aa, Artificial Sequence
  Description of Artificial Sequence: Synthetic peptide
ILSEWKEICV

SEQ ID NO: 1047 - protein, 9 aa, Artificial Sequence
  Description of Artificial Sequence: Synthetic peptide
IVWWCPMSR

SEQ ID NO: 1048 - protein, 10 aa, Artificial Sequence
  Description of Artificial Sequence: Synthetic peptide
IVWWCPMSRL

SEQ ID NO: 1049 - protein, 10 aa, Artificial Sequence
  Description of Artificial Sequence: Synthetic peptide
IWMTETLFDI

SEQ ID NO: 1050 - protein, 9 aa, Artificial Sequence
  Description of Artificial Sequence: Synthetic peptide
LLSILSEWK

SEQ ID NO: 1051 - protein, 9 aa, Artificial Sequence
  Description of Artificial Sequence: Synthetic peptide
MSAAQIAMV

SEQ ID NO: 1052 - protein, 9 aa, Artificial Sequence
  Description of Artificial Sequence: Synthetic peptide
MSRLRLALT

SEQ ID NO: 1053 - protein, 10 aa, Artificial Sequence
  Description of Artificial Sequence: Synthetic peptide
MSRLRLALTV

SEQ ID NO: 1054 - protein, 9 aa, Artificial Sequence
  Description of Artificial Sequence: Synthetic peptide
MVWPLLSIL

SEQ ID NO: 1055 - protein, 10 aa, Artificial Sequence
  Description of Artificial Sequence: Synthetic peptide
RLALTVPPST

SEQ ID NO: 1056 - protein, 9 aa, Artificial Sequence
  Description of Artificial Sequence: Synthetic peptide
TLFDIVWWC

SEQ ID NO: 1057 - protein, 10 aa, Artificial Sequence
  Description of Artificial Sequence: Synthetic peptide
TLFDIVWWCP

SEQ ID NO: 1058 - protein, 10 aa, Artificial Sequence
  Description of Artificial Sequence: Synthetic peptide
TMSAAQIAMV

SEQ ID NO: 1059 - protein, 10 aa, Artificial Sequence
  Description of Artificial Sequence: Synthetic peptide
VWSIWMTETL

SEQ ID NO: 1060 - protein, 9 aa, Artificial Sequence
  Description of Artificial Sequence: Synthetic peptide
WMTETLFDI

SEQ ID NO: 1061 - protein, 10 aa, Artificial Sequence
  Description of Artificial Sequence: Synthetic peptide
WMTETLFDIV

SEQ ID NO: 1062 - protein, 9 aa, Artificial Sequence
  Description of Artificial Sequence: Synthetic peptide
ALRCVFVPV

SEQ ID NO: 1063 - protein, 10 aa, Artificial Sequence
  Description of Artificial Sequence: Synthetic peptide
ALRCVFVPVL

SEQ ID NO: 1064 - protein, 9 aa, Artificial Sequence
  Description of Artificial Sequence: Synthetic peptide
ALSEHCPTT

SEQ ID NO: 1065 - protein, 10 aa, Artificial Sequence
  Description of Artificial Sequence: Synthetic peptide
AQRKRISARK

SEQ ID NO: 1066 - protein, 9 aa, Artificial Sequence
  Description of Artificial Sequence: Synthetic peptide
GAQRKRISA

SEQ ID NO: 1067 - protein, 9 aa, Artificial Sequence
  Description of Artificial Sequence: Synthetic peptide
HWMENISPF

SEQ ID NO: 1068 - protein, 9 aa, Artificial Sequence
  Description of Artificial Sequence: Synthetic peptide
LPSQRRNHW

SEQ ID NO: 1069 - protein, 10 aa, Artificial Sequence
  Description of Artificial Sequence: Synthetic peptide
LPSQRRNHWM

SEQ ID NO: 1070 - protein, 10 aa, Artificial Sequence
  Description of Artificial Sequence: Synthetic peptide
NISPFRSVGV

SEQ ID NO: 1071 - protein, 9 aa, Artificial Sequence
  Description of Artificial Sequence: Synthetic peptide
RISARKGSL

SEQ ID NO: 1072 - protein, 10 aa, Artificial Sequence
  Description of Artificial Sequence: Synthetic peptide
SPFRSVGVSA

SEQ ID NO: 1073 - protein, 10 aa, Artificial Sequence
  Description of Artificial Sequence: Synthetic peptide
SPSSHWKTPV

SEQ ID NO: 1074 - protein, 10 aa, Artificial Sequence
  Description of Artificial Sequence: Synthetic peptide
TALRCVFVPV

SEQ ID NO: 1075 - protein, 9 aa, Artificial Sequence
  Description of Artificial Sequence: Synthetic peptide
VIYWDGTAL

SEQ ID NO: 1076 - protein, 10 aa, Artificial Sequence
  Description of Artificial Sequence: Synthetic peptide
VIYWDGTALR

SEQ ID NO: 1077 - protein, 10 aa, Artificial Sequence
  Description of Artificial Sequence: Synthetic peptide
VLGETGAQRK

SEQ ID NO: 1078 - protein, 9 aa, Artificial Sequence
  Description of Artificial Sequence: Synthetic peptide
HPRPRHGHL

SEQ ID NO: 1079 - protein, 10 aa, Artificial Sequence
  Description of Artificial Sequence: Synthetic peptide
HPRPRHGHLQ

SEQ ID NO: 1080 - protein, 9 aa, Artificial Sequence
  Description of Artificial Sequence: Synthetic peptide
RPRHGHLQA

SEQ ID NO: 1081 - protein, 10 aa, Artificial Sequence
  Description of Artificial Sequence: Synthetic peptide
RPRHGHLQAV

SEQ ID NO: 1082 - protein, 10 aa, Artificial Sequence
  Description of Artificial Sequence: Synthetic peptide
GSLKTQVQMK

SEQ ID NO: 1083 - protein, 10 aa, Artificial Sequence
  Description of Artificial Sequence: Synthetic peptide
PPGPCHLLSL

SEQ ID NO: 1084 - protein, 10 aa, Artificial Sequence
  Description of Artificial Sequence: Synthetic peptide
RTILNNGSLK

SEQ ID NO: 1085 - protein, 9 aa, Artificial Sequence
  Description of Artificial Sequence: Synthetic peptide
SLKTQVQMK

SEQ ID NO: 1086 - protein, 10 aa, Artificial Sequence
  Description of Artificial Sequence: Synthetic peptide
SLKTQVQMKL

SEQ ID NO: 1087 - protein, 9 aa, Artificial Sequence
  Description of Artificial Sequence: Synthetic peptide
TILNNGSLK

SEQ ID NO: 1088 - protein, 10 aa, Artificial Sequence
  Description of Artificial Sequence: Synthetic peptide
CPPCRPKQWM

SEQ ID NO: 1089 - protein, 10 aa, Artificial Sequence
  Description of Artificial Sequence: Synthetic peptide
TTFCPPCRPK

SEQ ID NO: 1090 - protein, 10 aa, Artificial Sequence
  Description of Artificial Sequence: Synthetic peptide
CFANWPRPAL

SEQ ID NO: 1091 - protein, 9 aa, Artificial Sequence
  Description of Artificial Sequence: Synthetic peptide
FANWPRPAL

SEQ ID NO: 1092 - protein, 9 aa, Artificial Sequence
  Description of Artificial Sequence: Synthetic peptide
GLIPHPRPA

SEQ ID NO: 1093 - protein, 9 aa, Artificial Sequence
  Description of Artificial Sequence: Synthetic peptide
HPRPAPASA

SEQ ID NO: 1094 - protein, 10 aa, Artificial Sequence
  Description of Artificial Sequence: Synthetic peptide
HPRPAPASAP

SEQ ID NO: 1095 - protein, 9 aa, Artificial Sequence
  Description of Artificial Sequence: Synthetic peptide
IPHPRPAPA

SEQ ID NO: 1096 - protein, 10 aa, Artificial Sequence
  Description of Artificial Sequence: Synthetic peptide
IPHPRPAPAS

SEQ ID NO: 1097 - protein, 9 aa, Artificial Sequence
  Description of Artificial Sequence: Synthetic peptide
RPALCSCGL

SEQ ID NO: 1098 - protein, 10 aa, Artificial Sequence
  Description of Artificial Sequence: Synthetic peptide
RPALCSCGLI

SEQ ID NO: 1099 - protein, 9 aa, Artificial Sequence
  Description of Artificial Sequence: Synthetic peptide
TPLPSTRCF

SEQ ID NO: 1100 - protein, 9 aa, Artificial Sequence
  Description of Artificial Sequence: Synthetic peptide
WPRPALCSC

SEQ ID NO: 1101 - protein, 10 aa, Artificial Sequence
  Description of Artificial Sequence: Synthetic peptide
WPRPALCSCG

SEQ ID NO: 1102 - protein, 10 aa, Artificial Sequence
  Description of Artificial Sequence: Synthetic peptide
ALRRSGRPPK

SEQ ID NO: 1103 - protein, 9 aa, Artificial Sequence
  Description of Artificial Sequence: Synthetic peptide
GLVPSLVSK

SEQ ID NO: 1104 - protein, 9 aa, Artificial Sequence
  Description of Artificial Sequence: Synthetic peptide
KISVETYTV

SEQ ID NO: 1105 - protein, 10 aa, Artificial Sequence
  Description of Artificial Sequence: Synthetic peptide
LLMVLMSLDL

SEQ ID NO: 1106 - protein, 10 aa, Artificial Sequence
  Description of Artificial Sequence: Synthetic peptide
LMSLDLDTGL

SEQ ID NO: 1107 - protein, 9 aa, Artificial Sequence
  Description of Artificial Sequence: Synthetic peptide
LMVLMSLDL

SEQ ID NO: 1108 - protein, 10 aa, Artificial Sequence
  Description of Artificial Sequence: Synthetic peptide
LVSKCLILRV

SEQ ID NO: 1109 - protein, 9 aa, Artificial Sequence
  Description of Artificial Sequence: Synthetic peptide
QLLMVLMSL

SEQ ID NO: 1110 - protein, 9 aa, Artificial Sequence
  Description of Artificial Sequence: Synthetic peptide
RPGAADTGA

SEQ ID NO: 1111 - protein, 10 aa, Artificial Sequence
  Description of Artificial Sequence: Synthetic peptide
RPGAADTGAH

SEQ ID NO: 1112 - protein, 9 aa, Artificial Sequence
  Description of Artificial Sequence: Synthetic peptide
SLDLDTGLV

SEQ ID NO: 1113 - protein, 9 aa, Artificial Sequence
  Description of Artificial Sequence: Synthetic peptide
SLVSKCLIL

SEQ ID NO: 1114 - protein, 10 aa, Artificial Sequence
  Description of Artificial Sequence: Synthetic peptide
SQLLMVLMSL

SEQ ID NO: 1115 - protein, 9 aa, Artificial Sequence
  Description of Artificial Sequence: Synthetic peptide
TVSSQLLMV

SEQ ID NO: 1116 - protein, 9 aa, Artificial Sequence
  Description of Artificial Sequence: Synthetic peptide
TYTVSSQLL

SEQ ID NO: 1117 - protein, 10 aa, Artificial Sequence
  Description of Artificial Sequence: Synthetic peptide
TYTVSSQLLM

SEQ ID NO: 1118 - protein, 9 aa, Artificial Sequence
  Description of Artificial Sequence: Synthetic peptide
VLMSLDLDT

SEQ ID NO: 1119 - protein, 9 aa, Artificial Sequence
  Description of Artificial Sequence: Synthetic peptide
VPSLVSKCL

SEQ ID NO: 1120 - protein, 10 aa, Artificial Sequence
  Description of Artificial Sequence: Synthetic peptide
VSKCLILRVK

SEQ ID NO: 1121 - protein, 9 aa, Artificial Sequence
  Description of Artificial Sequence: Synthetic peptide
YTVSSQLLM

SEQ ID NO: 1122 - protein, 10 aa, Artificial Sequence
  Description of Artificial Sequence: Synthetic peptide
YTVSSQLLMV

SEQ ID NO: 1123 - protein, 9 aa, Artificial Sequence
  Description of Artificial Sequence: Synthetic peptide
FCQYHTASV

SEQ ID NO: 1124 - protein, 9 aa, Artificial Sequence
  Description of Artificial Sequence: Synthetic peptide
CPYGSTSTA

SEQ ID NO: 1125 - protein, 10 aa, Artificial Sequence
  Description of Artificial Sequence: Synthetic peptide
CPYGSTSTAS

SEQ ID NO: 1126 - protein, 10 aa, Artificial Sequence
  Description of Artificial Sequence: Synthetic peptide
LARAAASTAT

SEQ ID NO: 1127 - protein, 9 aa, Artificial Sequence
  Description of Artificial Sequence: Synthetic peptide
MLTDSLFLP

SEQ ID NO: 1128 - protein, 10 aa, Artificial Sequence
  Description of Artificial Sequence: Synthetic peptide
PPRSSSAIAV

SEQ ID NO: 1129 - protein, 10 aa, Artificial Sequence
  Description of Artificial Sequence: Synthetic peptide
RAAASTATEV

SEQ ID NO: 1130 - protein, 9 aa, Artificial Sequence
  Description of Artificial Sequence: Synthetic peptide
SPPRSSSAI

SEQ ID NO: 1131 - protein, 10 aa, Artificial Sequence
  Description of Artificial Sequence: Synthetic peptide
SPPRSSSAIA

SEQ ID NO: 1132 - protein, 9 aa, Artificial Sequence
  Description of Artificial Sequence: Synthetic peptide
SPTQRCRLA

SEQ ID NO: 1133 - protein, 9 aa, Artificial Sequence
  Description of Artificial Sequence: Synthetic peptide
TQRCRLARA

SEQ ID NO: 1134 - protein, 10 aa, Artificial Sequence
  Description of Artificial Sequence: Synthetic peptide
TQRCRLARAA

SEQ ID NO: 1135 - protein, 10 aa, Artificial Sequence
  Description of Artificial Sequence: Synthetic peptide
KIWKTTQMCR

SEQ ID NO: 1136 - protein, 9 aa, Artificial Sequence
  Description of Artificial Sequence: Synthetic peptide
WTSSGRSTK

SEQ ID NO: 1137 - protein, 9 aa, Artificial Sequence
  Description of Artificial Sequence: Synthetic peptide
ALGELARAL

SEQ ID NO: 1138 - protein, 9 aa, Artificial Sequence
  Description of Artificial Sequence: Synthetic peptide
AQLRRRAAA

SEQ ID NO: 1139 - protein, 10 aa, Artificial Sequence
  Description of Artificial Sequence: Synthetic peptide
AQLRRRAAAL

SEQ ID NO: 1140 - protein, 10 aa, Artificial Sequence
  Description of Artificial Sequence: Synthetic peptide
ARRAARMAQL

SEQ ID NO: 1141 - protein, 9 aa, Artificial Sequence
  Description of Artificial Sequence: Synthetic peptide
HPQLPRSPL

SEQ ID NO: 1142 - protein, 10 aa, Artificial Sequence
  Description of Artificial Sequence: Synthetic peptide
HPQLPRSPLA

SEQ ID NO: 1143 - protein, 9 aa, Artificial Sequence
  Description of Artificial Sequence: Synthetic peptide
LARALPGHL

SEQ ID NO: 1144 - protein, 10 aa, Artificial Sequence
  Description of Artificial Sequence: Synthetic peptide
LARALPGHLL

SEQ ID NO: 1145 - protein, 9 aa, Artificial Sequence
  Description of Artificial Sequence: Synthetic peptide
MAQLRRRAA

SEQ ID NO: 1146 - protein, 10 aa, Artificial Sequence
  Description of Artificial Sequence: Synthetic peptide
MAQLRRRAAA

SEQ ID NO: 1147 - protein, 9 aa, Artificial Sequence
  Description of Artificial Sequence: Synthetic peptide
QLRRRAAAL

SEQ ID NO: 1148 - protein, 10 aa, Artificial Sequence
  Description of Artificial Sequence: Synthetic peptide
RAAALPNAAA

SEQ ID NO: 1149 - protein, 10 aa, Artificial Sequence
  Description of Artificial Sequence: Synthetic peptide
RMAQLRRRAA

SEQ ID NO: 1150 - protein, 10 aa, Artificial Sequence
  Description of Artificial Sequence: Synthetic peptide
SQSARRAARM

SEQ ID NO: 1151 - protein, 10 aa, Artificial Sequence
  Description of Artificial Sequence: Synthetic peptide
GMTLGEKFRV

SEQ ID NO: 1152 - protein, 9 aa, Artificial Sequence
  Description of Artificial Sequence: Synthetic peptide
RVGNCKHLK

SEQ ID NO: 1153 - protein, 9 aa, Artificial Sequence
  Description of Artificial Sequence: Synthetic peptide
GPSEPGNNI

SEQ ID NO: 1154 - protein, 10 aa, Artificial Sequence
  Description of Artificial Sequence: Synthetic peptide
KICNESASRK

SEQ ID NO: 1155 - protein, 10 aa, Artificial Sequence
  Description of Artificial Sequence: Synthetic peptide
GIQVLNVSLK

SEQ ID NO: 1156 - protein, 9 aa, Artificial Sequence
  Description of Artificial Sequence: Synthetic peptide
IQVLNVSLK

SEQ ID NO: 1157 - protein, 9 aa, Artificial Sequence
  Description of Artificial Sequence: Synthetic peptide
KSSSNVISY

SEQ ID NO: 1158 - protein, 9 aa, Artificial Sequence
  Description of Artificial Sequence: Synthetic peptide
KYGWSLLRV

SEQ ID NO: 1159 - protein, 9 aa, Artificial Sequence
  Description of Artificial Sequence: Synthetic peptide
RSWKYGWSL

SEQ ID NO: 1160 - protein, 9 aa, Artificial Sequence
  Description of Artificial Sequence: Synthetic peptide
SLKSSSNVI

SEQ ID NO: 1161 - protein, 9 aa, Artificial Sequence
  Description of Artificial Sequence: Synthetic peptide
SWKYGWSLL

SEQ ID NO: 1162 - protein, 9 aa, Artificial Sequence
  Description of Artificial Sequence: Synthetic peptide
TVANGRSWK

SEQ ID NO: 1163 - protein, 9 aa, Artificial Sequence
  Description of Artificial Sequence: Synthetic peptide
VPQVNGIQV

SEQ ID NO: 1164 - protein, 10 aa, Artificial Sequence
  Description of Artificial Sequence: Synthetic peptide
VPQVNGIQVL

SEQ ID NO: 1165 - protein, 10 aa, Artificial Sequence
  Description of Artificial Sequence: Synthetic peptide
VTVANGRSWK

SEQ ID NO: 1166 - protein, 9 aa, Artificial Sequence
  Description of Artificial Sequence: Synthetic peptide
WSLLRVPQV

SEQ ID NO: 1167 - protein, 10 aa, Artificial Sequence
  Description of Artificial Sequence: Synthetic peptide
HPGDCLIFKL

SEQ ID NO: 1168 - protein, 9 aa, Artificial Sequence
  Description of Artificial Sequence: Synthetic peptide
KLRVPGSSV

SEQ ID NO: 1169 - protein, 10 aa, Artificial Sequence
  Description of Artificial Sequence: Synthetic peptide
KLRVPGSSVL

SEQ ID NO: 1170 - protein, 9 aa, Artificial Sequence
  Description of Artificial Sequence: Synthetic peptide
RVPGSSVLV

SEQ ID NO: 1171 - protein, 9 aa, Artificial Sequence
  Description of Artificial Sequence: Synthetic peptide
SVLVTVPGL

SEQ ID NO: 1172 - protein, 10 aa, Artificial Sequence
  Description of Artificial Sequence: Synthetic peptide
VPGSSVLVTV

SEQ ID NO: 1173 - protein, 10 aa, Artificial Sequence
  Description of Artificial Sequence: Synthetic peptide
ALLLRPRPPR

SEQ ID NO: 1174 - protein, 10 aa, Artificial Sequence
  Description of Artificial Sequence: Synthetic peptide
ALSALLLRPR

SEQ ID NO: 1175 - protein, 9 aa, Artificial Sequence
  Description of Artificial Sequence: Synthetic peptide
LTINKEEAL

SEQ ID NO: 1176 - protein, 9 aa, Artificial Sequence
  Description of Artificial Sequence: Synthetic peptide
IVHSATGFK

SEQ ID NO: 1177 - protein, 9 aa, Artificial Sequence
  Description of Artificial Sequence: Synthetic peptide
ATGFKQSSK

SEQ ID NO: 1178 - protein, 9 aa, Artificial Sequence
  Description of Artificial Sequence: Synthetic peptide
ELFPLIFPA

SEQ ID NO: 1179 - protein, 9 aa, Artificial Sequence
  Description of Artificial Sequence: Synthetic peptide
KGPELFPLI

SEQ ID NO: 1180 - protein, 10 aa, Artificial Sequence
  Description of Artificial Sequence: Synthetic peptide
KGPELFPLIF

SEQ ID NO: 1181 - protein, 11 aa, Artificial Sequence
  Description of Artificial Sequence: Synthetic peptide
KPTDAPPKAGV

SEQ ID NO: 1182 - protein, 10 aa, Artificial Sequence
  Description of Artificial Sequence: Synthetic peptide
ALEEKKGNYV

SEQ ID NO: 1183 - protein, 10 aa, Artificial Sequence
  Description of Artificial Sequence: Synthetic peptide
IQLQDKFEHL

SEQ ID NO: 1184 - protein, 9 aa, Artificial Sequence
  Description of Artificial Sequence: Synthetic peptide
QLQDKFEHL

SEQ ID NO: 1185 - protein, 10 aa, Artificial Sequence
  Description of Artificial Sequence: Synthetic peptide
QLQDKFEHLK

SEQ ID NO: 1186 - protein, 10 aa, Artificial Sequence
  Description of Artificial Sequence: Synthetic peptide
YLVIQLQDKF

SEQ ID NO: 1187 - protein, 10 aa, Artificial Sequence
  Description of Artificial Sequence: Synthetic peptide
QVYRRKHQEL

SEQ ID NO: 1188 - protein, 9 aa, Artificial Sequence
  Description of Artificial Sequence: Synthetic peptide
STREKNSQV

SEQ ID NO: 1189 - protein, 9 aa, Artificial Sequence
  Description of Artificial Sequence: Synthetic peptide
VYRRKHQEL

SEQ ID NO: 1190 - protein, 9 aa, Artificial Sequence
  Description of Artificial Sequence: Synthetic peptide
VLTVTSTDV

SEQ ID NO: 1191 - protein, 10 aa, Artificial Sequence
  Description of Artificial Sequence: Synthetic peptide
VLTVTSTDVK

SEQ ID NO: 1192 - protein, 9 aa, Artificial Sequence
  Description of Artificial Sequence: Synthetic peptide
IMSLWGLVS

SEQ ID NO: 1193 - protein, 10 aa, Artificial Sequence
  Description of Artificial Sequence: Synthetic peptide
IMSLWGLVSK

SEQ ID NO: 1194 - protein, 9 aa, Artificial Sequence
  Description of Artificial Sequence: Synthetic peptide
KLKQEATSK

SEQ ID NO: 1195 - protein, 9 aa, Artificial Sequence
  Description of Artificial Sequence: Synthetic peptide
QIMSLWGLV

SEQ ID NO: 1196 - protein, 9 aa, Artificial Sequence
  Description of Artificial Sequence: Synthetic peptide
SQIMSLWGL

SEQ ID NO: 1197 - protein, 10 aa, Artificial Sequence
  Description of Artificial Sequence: Synthetic peptide
SQIMSLWGLV

SEQ ID NO: 1198 - protein, 9 aa, Artificial Sequence
  Description of Artificial Sequence: Synthetic peptide
TSKSQIMSL

SEQ ID NO: 1199 - protein, 10 aa, Artificial Sequence
  Description of Artificial Sequence: Synthetic peptide
LLQEFDVQEA

SEQ ID NO: 1200 - protein, 10 aa, Artificial Sequence
  Description of Artificial Sequence: Synthetic peptide
LQEFDVQEAL

SEQ ID NO: 1201 - protein, 9 aa, Artificial Sequence
  Description of Artificial Sequence: Synthetic peptide
GPREPRNRT

SEQ ID NO: 1202 - protein, 10 aa, Artificial Sequence
  Description of Artificial Sequence: Synthetic peptide
RNRTEKHSTM

SEQ ID NO: 1203 - protein, 9 aa, Artificial Sequence
  Description of Artificial Sequence: Synthetic peptide
ALNSEALSV

SEQ ID NO: 1204 - protein, 10 aa, Artificial Sequence
  Description of Artificial Sequence: Synthetic peptide
ALNSEALSVV

SEQ ID NO: 1205 - protein, 10 aa, Artificial Sequence
  Description of Artificial Sequence: Synthetic peptide
MALNSEALSV

SEQ ID NO: 1206 - protein, 67 aa, Artificial Sequence
  Description of Artificial Sequence: Synthetic polypeptide
MSDVAIVKEGWLHKRGKYIKTWRPRYFLLKNDGTFIGYKERPQDVDQREAPLNNFSVAQCQLMKTER

SEQ ID NO: 1207 - protein, 101 aa, Artificial Sequence
  Description of Artificial Sequence: Synthetic polypeptide
TMLVLEGSGNLVLYTGVVRVGKVFIPGLPAPSLTMSNTMPRPSTPLDGVSAPKPLSKLLGSLDEVVLLSPVPELRDSSKLHDSLYNEDCTFQQLGTYIHSI

SEQ ID NO: 1208 - protein, 101 aa, Artificial Sequence; identical to SEQ ID NO: 256
  Description of Artificial Sequence: Synthetic polypeptide

SEQ ID NO: 1209 - protein, 90 aa, Artificial Sequence
  Description of Artificial Sequence: Synthetic polypeptide
MREPIYMHSTMVFLPWELHTKKGPSPPEQFMAVKLSDSRTALKSGYGKYLGINSDELVGHSDAIGPREQWEPVFQNGKMALLASNSCFIR

SEQ ID NO: 1210 - protein, 101 aa, Artificial Sequence; identical to SEQ ID NO: 257
  Description of Artificial Sequence: Synthetic polypeptide

SEQ ID NO: 1211 - protein, 101 aa, Artificial Sequence
  Description of Artificial Sequence: Synthetic polypeptide
AMPNQAQMRILKETELRKVKVLGSGAFGTVYKGIWIPDGENVKIPVAIKVSRENTSPKANKEILDEAYVMAGVGSPYVSRLLGICLTSTVQLVTQLMPYGC

SEQ ID NO: 1212 - protein, 101 aa, Artificial Sequence; identical to SEQ ID NO: 261
  Description of Artificial Sequence: Synthetic polypeptide

SEQ ID NO: 1213 - protein, 62 aa, Artificial Sequence
  Description of Artificial Sequence: Synthetic polypeptide
MTEYKLVVVGACGVGKSALTIQLIQNHFVDEYDPTIEDSYRKQVVIDGETCLLDILDTAGQE

SEQ ID NO: 1214 - protein, 62 aa, Artificial Sequence
  Description of Artificial Sequence: Synthetic polypeptide
MTEYKLVVVGADGVGKSALTIQLIQNHFVDEYDPTIEDSYRKQVVIDGETCLLDILDTAGQE

SEQ ID NO: 1215 - protein, 62 aa, Artificial Sequence
  Description of Artificial Sequence: Synthetic polypeptide
MTEYKLVVVGAVGVGKSALTIQLIQNHFVDEYDPTIEDSYRKQVVIDGETCLLDILDTAGQE

SEQ ID NO: 1216 - protein, 101 aa, Artificial Sequence
  Description of Artificial Sequence: Synthetic polypeptide
AGGVGKSALTIQLIQNHFVDEYDPTIEDSYRKQVVIDGETCLLDILDTAGHEEYSAMRDQYMRTGEGFLCVFAINNTKSFEDIHHYREQIKRVKDSEDVPM

SEQ ID NO: 1217 - protein, 101 aa, Artificial Sequence
  Description of Artificial Sequence: Synthetic polypeptide
AGGVGKSALTIQLIQNHFVDEYDPTIEDSYRKQVVIDGETCLLDILDTAGLEEYSAMRDQYMRTGEGFLCVFAINNTKSFEDIHHYREQIKRVKDSEDVPM

SEQ ID NO: 1218 - protein, 101 aa, Artificial Sequence
  Description of Artificial Sequence: Synthetic polypeptide
AGGVGKSALTIQLIQNHFVDEYDPTIEDSYRKQVVIDGETCLLDILDTAGKEEYSAMRDQYMRTGEGFLCVFAINNSKSFADINLYREQIKRVKDSDDVPM

SEQ ID NO: 1219 - protein, 101 aa, Artificial Sequence
  Description of Artificial Sequence: Synthetic polypeptide
AGGVGKSALTIQLIQNHFVDEYDPTIEDSYRKQVVIDGETCLLDILDTAGREEYSAMRDQYMRTGEGFLCVFAINNSKSFADINLYREQIKRVKDSDDVPM

SEQ ID NO: 1220 - protein, 101 aa, Artificial Sequence; identical to SEQ ID NO: 271
  Description of Artificial Sequence: Synthetic polypeptide

SEQ ID NO: 1221 - protein, 101 aa, Artificial Sequence; identical to SEQ ID NO: 275
  Description of Artificial Sequence: Synthetic polypeptide

SEQ ID NO: 1222 - protein, 79 aa, Artificial Sequence; identical to SEQ ID NO: 276
  Description of Artificial Sequence: Synthetic polypeptide

SEQ ID NO: 1223 - protein, 101 aa, Artificial Sequence
  Description of Artificial Sequence: Synthetic polypeptide
AVCKSKKSWQARHTGIKIVQQIAILMGCAILPHLRSLVEIIEHGLVDEQQEVRTISALAIAALAEAATPYGIESFDSVLKPLWKGIRQHRGKGLAAFLKAI

SEQ ID NO: 1224 - protein, 101 aa, Artificial Sequence
  Description of Artificial Sequence: Synthetic polypeptide
YLSLYLLLVSCPKSEVRAKFKFSILNAKGEETKAMESQRAYRFVQGKDWGLKKFIRRDFLLDEANGLLPDDKLTLFCEVSVVQDSVNISGQNTMNMVKVPE

SEQ ID NO: 1225 - protein, 101 aa, Artificial Sequence
  Description of Artificial Sequence: Synthetic polypeptide
YLSLYLLLVSCPKSEVRAKFKFSILNAKGEETKAMESQRAYRFVQGKDWGVKKFIRRDFLLDEANGLLPDDKLTLFCEVSVVQDSVNISGQNTMNMVKVPE

SEQ ID NO: 1226 - protein, 101 aa, Artificial Sequence; identical to SEQ ID NO: 277
  Description of Artificial Sequence: Synthetic polypeptide

SEQ ID NO: 1227 - protein, 101 aa, Artificial Sequence; identical to SEQ ID NO: 279
  Description of Artificial Sequence: Synthetic polypeptide

SEQ ID NO: 1228 - protein, 101 aa, Artificial Sequence; identical to SEQ ID NO: 280
  Description of Artificial Sequence: Synthetic polypeptide

SEQ ID NO: 1229 - protein, 101 aa, Artificial Sequence; identical to SEQ ID NO: 281
  Description of Artificial Sequence: Synthetic polypeptide

SEQ ID NO: 1230 - protein, 101 aa, Artificial Sequence
  Description of Artificial Sequence: Synthetic polypeptide
PEVGSDCTTIHYNYMCNSSCMGGMNRRPILTIITLEDSSGNLLGRNSFEVHVCACPGRDRRTEEENLRKKGEPHHELPPGSTKRALPNNTSSSPQPKKKPL

SEQ ID NO: 1231 - protein, 101 aa, Artificial Sequence
  Description of Artificial Sequence: Synthetic polypeptide
TEVVRRCPHHERCSDSDGLAPPQHLIRVEGNLRVEYLDDRNTFRHSVVVPCEPPEVGSDCTTIHYNYMCNSSCMGGMNRRPILTIITLEDSSGNLLGRNSF

SEQ ID NO: 1232 - protein, 54 aa, Artificial Sequence
  Description of Artificial Sequence: Synthetic polypeptide
YNFDKNYKDWQSAVECIAVLDVLLCLANYSRGGDGPMCRPVILLPEDTPPLLRA

SEQ ID NO: 1233 - protein, 93 aa, Artificial Sequence; identical to SEQ ID NO: 318
  Description of Artificial Sequence: Synthetic polypeptide

SEQ ID NO: 1234 - protein, 179 aa, Artificial Sequence; identical to SEQ ID NO: 321
  Description of Artificial Sequence: Synthetic polypeptide

SEQ ID NO: 1235 - protein, 67 aa, Artificial Sequence
  Description of Artificial Sequence: Synthetic polypeptide
RSYRRMIHLWWTAQISLGVCRSLTVACCTGGLVGGTPLSISRPTSRARQSCCLPGLTHPAHQPLGSM

SEQ ID NO: 1236 - protein, 60 aa, Artificial Sequence
  Description of Artificial Sequence: Synthetic polypeptide
QHSGRDVSLRGLSCARATLSFWPGGYPAYSKDSGLLTSSSREWKVKFPELLCVWVSSIRH

SEQ ID NO: 1237 - protein, 48 aa, Artificial Sequence
  Description of Artificial Sequence: Synthetic polypeptide
AQAKAVCSQESRDVLCELSDHHNHTLEEECQWGPCLQCLWALLQASQY

SEQ ID NO: 1238 - protein, 113 aa, Artificial Sequence; identical to SEQ ID NO: 334
  Description of Artificial Sequence: Synthetic polypeptide

SEQ ID NO: 1239 - protein, 494 aa, Artificial Sequence; identical to SEQ ID NO: 336
  Description of Artificial Sequence: Synthetic polypeptide

SEQ ID NO: 1240 - protein, 35 aa, Artificial Sequence
  Description of Artificial Sequence: Synthetic polypeptide
GPRSHPLPRLWHLLLQVTQTSFALAPTLTHMLSPH

SEQ ID NO: 1241 - protein, 172 aa, Artificial Sequence
  Description of Artificial Sequence: Synthetic polypeptide
PLGLVPWTRWCPQGKPRFPAMSTTTATGTTTTKSGSSGMAGSLAQKPESPSPGLLFLGHSPSQSHLLLISKSPDPTQQPLRGGSLTHSAPGPSLSQPLAQLTPPASAPVPAVCSTCKNPASLPDTHRGKGGGVPPSPPLALGPRMQLCTQLARFFPITPPVWHILGPQRHTP

SEQ ID NO: 1242 - protein, 97 aa, Artificial Sequence; identical to SEQ ID NO: 310
  Description of Artificial Sequence: Synthetic polypeptide

SEQ ID NO: 1243 - protein, 78 aa, Artificial Sequence; identical to SEQ ID NO: 348
  Description of Artificial Sequence: Synthetic polypeptide

SEQ ID NO: 1244 - protein, 46 aa, Artificial Sequence; identical to SEQ ID NO: 350
  Description of Artificial Sequence: Synthetic polypeptide

SEQ ID NO: 1245 - protein, 77 aa, Artificial Sequence
  Description of Artificial Sequence: Synthetic polypeptide
SQGLYSSSASSGKCLMEVTVDRNCLEVLPTKMSYAANLKNVMNMQNRQKKKGKNSPCCQKKLRVQNQGHLLMILLHN

SEQ ID NO: 1246 - protein, 91 aa, Artificial Sequence; identical to SEQ ID NO: 354
  Description of Artificial Sequence: Synthetic polypeptide

SEQ ID NO: 1247 - protein, 104 aa, Artificial Sequence
  Description of Artificial Sequence: Synthetic polypeptide
LGSGAFGTVYKGIWIPDGENVKIPVAIKVLRENTSPKANKEILDEAYVMAYVMAGVGSPYVSRLLGICLTSTVQLVTQLMPYGCLLDHVRENRGRLGSQDLLNW

SEQ ID NO: 1248 - protein, 10 aa, Artificial Sequence
  Description of Artificial Sequence: Synthetic peptide
KYIKTWRPRY

SEQ ID NO: 1249 - protein, 9 aa, Artificial Sequence
  Description of Artificial Sequence: Synthetic peptide
WLHKRGKYI

SEQ ID NO: 1250 - protein, 10 aa, Artificial Sequence
  Description of Artificial Sequence: Synthetic peptide
WLHKRGKYIK

SEQ ID NO: 1251 - protein, 9 aa, Artificial Sequence
  Description of Artificial Sequence: Synthetic peptide
APKPLSKLL

SEQ ID NO: 1252 - protein, 10 aa, Artificial Sequence
  Description of Artificial Sequence: Synthetic peptide
GVSAPKPLSK

SEQ ID NO: 1253 - protein, 9 aa, Artificial Sequence
  Description of Artificial Sequence: Synthetic peptide
VSAPKPLSK

SEQ ID NO: 1254 - protein, 9 aa, Artificial Sequence
  Description of Artificial Sequence: Synthetic peptide
CPHRPILQA

SEQ ID NO: 1255 - protein, 9 aa, Artificial Sequence
  Description of Artificial Sequence: Synthetic peptide
KLSDSRTAL

SEQ ID NO: 1256 - protein, 10 aa, Artificial Sequence
  Description of Artificial Sequence: Synthetic peptide
KLSDSRTALK

SEQ ID NO: 1257 - protein, 9 aa, Artificial Sequence
  Description of Artificial Sequence: Synthetic peptide
LSDSRTALK

SEQ ID NO: 1258 - protein, 10 aa, Artificial Sequence
  Description of Artificial Sequence: Synthetic peptide
RTALKSGYGK

SEQ ID NO: 1259 - protein, 9 aa, Artificial Sequence
  Description of Artificial Sequence: Synthetic peptide
TALKSGYGK

SEQ ID NO: 1260 - protein, 9 aa, Artificial Sequence
  Description of Artificial Sequence: Synthetic peptide
ALSASNSCF

SEQ ID NO: 1261 - protein, 10 aa, Artificial Sequence
  Description of Artificial Sequence: Synthetic peptide
ALSASNSCFI

SEQ ID NO: 1262 - protein, 10 aa, Artificial Sequence
  Description of Artificial Sequence: Synthetic peptide
FQNGKMALSA

SEQ ID NO: 1263 - protein, 10 aa, Artificial Sequence
  Description of Artificial Sequence: Synthetic peptide
KVSRENTSPK

SEQ ID NO: 1264 - protein, 10 aa, Artificial Sequence
  Description of Artificial Sequence: Synthetic peptide
KPIIIGGHAY

SEQ ID NO: 1265 - protein, 10 aa, Artificial Sequence
  Description of Artificial Sequence: Synthetic peptide
KLVVVGACGV

SEQ ID NO: 1266 - protein, 9 aa, Artificial Sequence
  Description of Artificial Sequence: Synthetic peptide
LVVVGACGV

SEQ ID NO: 1267 - protein, 9 aa, Artificial Sequence
  Description of Artificial Sequence: Synthetic peptide
VVGACGVGK

SEQ ID NO: 1268 - protein, 10 aa, Artificial Sequence
  Description of Artificial Sequence: Synthetic peptide
VVVGACGVGK

SEQ ID NO: 1269 - protein, 9 aa, Artificial Sequence
  Description of Artificial Sequence: Synthetic peptide
VVGADGVGK

SEQ ID NO: 1270 - protein, 10 aa, Artificial Sequence
  Description of Artificial Sequence: Synthetic peptide
VVVGADGVGK

SEQ ID NO: 1271 - protein, 10 aa, Artificial Sequence
  Description of Artificial Sequence: Synthetic peptide
KLVVVGADGV

SEQ ID NO: 1272 - protein, 9 aa, Artificial Sequence
  Description of Artificial Sequence: Synthetic peptide
LVVVGADGV

SEQ ID NO: 1273 - protein, 10 aa, Artificial Sequence
  Description of Artificial Sequence: Synthetic peptide
KLVVVGAVGV

SEQ ID NO: 1274 - protein, 9 aa, Artificial Sequence
  Description of Artificial Sequence: Synthetic peptide
LVVVGAVGV

SEQ ID NO: 1275 - protein, 9 aa, Artificial Sequence
  Description of Artificial Sequence: Synthetic peptide
VVGAVGVGK

SEQ ID NO: 1276 - protein, 10 aa, Artificial Sequence
  Description of Artificial Sequence: Synthetic peptide
VVVGAVGVGK

SEQ ID NO: 1277 - protein, 10 aa, Artificial Sequence
  Description of Artificial Sequence: Synthetic peptide
ILDTAGHEEY

SEQ ID NO: 1278 - protein, 10 aa, Artificial Sequence
  Description of Artificial Sequence: Synthetic peptide
ILDTAGLEEY

SEQ ID NO: 1279 - protein, 10 aa, Artificial Sequence
  Description of Artificial Sequence: Synthetic peptide
LLDILDTAGL

SEQ ID NO: 1280 - protein, 10 aa, Artificial Sequence
  Description of Artificial Sequence: Synthetic peptide
ILDTAGKEEY

SEQ ID NO: 1281 - protein, 10 aa, Artificial Sequence
  Description of Artificial Sequence: Synthetic peptide
ILDTAGREEY

SEQ ID NO: 1282 - protein, 10 aa, Artificial Sequence
  Description of Artificial Sequence: Synthetic peptide
AISTRDPLSK

SEQ ID NO: 1283 - protein, 9 aa, Artificial Sequence
  Description of Artificial Sequence: Synthetic peptide
QTGVMICAY

SEQ ID NO: 1284 - protein, 9 aa, Artificial Sequence
  Description of Artificial Sequence: Synthetic peptide
FSGEYIPTV

SEQ ID NO: 1285 - protein, 9 aa, Artificial Sequence
  Description of Artificial Sequence: Synthetic peptide
TTNAFSGEY

SEQ ID NO: 1286 - protein, 10 aa, Artificial Sequence
  Description of Artificial Sequence: Synthetic peptide
YTTNAFSGEY

SEQ ID NO: 1287 - protein, 9 aa, Artificial Sequence
  Description of Artificial Sequence: Synthetic peptide
GLVDEQQEV

SEQ ID NO: 1288 - protein, 9 aa, Artificial Sequence
  Description of Artificial Sequence: Synthetic peptide
FVQGKDWGL

SEQ ID NO: 1289 - protein, 9 aa, Artificial Sequence
  Description of Artificial Sequence: Synthetic peptide
FVQGKDWGV

SEQ ID NO: 1290 - protein, 10 aa, Artificial Sequence
  Description of Artificial Sequence: Synthetic peptide
CMGSMNRRPI

SEQ ID NO: 1291 - protein, 9 aa, Artificial Sequence
  Description of Artificial Sequence: Synthetic peptide
GSMNRRPIL

SEQ ID NO: 1292 - protein, 9 aa, Artificial Sequence
  Description of Artificial Sequence: Synthetic peptide
MGSMNRRPI

SEQ ID NO: 1293 - protein, 10 aa, Artificial Sequence
  Description of Artificial Sequence: Synthetic peptide
MGSMNRRPIL

SEQ ID NO: 1294 - protein, 10 aa, Artificial Sequence
  Description of Artificial Sequence: Synthetic peptide
SMNRRPILTI

SEQ ID NO: 1295 - protein, 10 aa, Artificial Sequence
  Description of Artificial Sequence: Synthetic peptide
CMGGMNQRPI

SEQ ID NO: 1296 - protein, 10 aa, Artificial Sequence
  Description of Artificial Sequence: Synthetic peptide
GMNQRPILTI

SEQ ID NO: 1297 - protein, 9 aa, Artificial Sequence
  Description of Artificial Sequence: Synthetic peptide
NQRPILTII

SEQ ID NO: 1298 - protein, 10 aa, Artificial Sequence
  Description of Artificial Sequence: Synthetic peptide
CMGGMNWRPI

SEQ ID NO: 1299 - protein, 10 aa, Artificial Sequence
  Description of Artificial Sequence: Synthetic peptide
GMNWRPILTI

SEQ ID NO: 1300 - protein, 9 aa, Artificial Sequence
  Description of Artificial Sequence: Synthetic peptide
MNWRPILTI

SEQ ID NO: 1301 - protein, 10 aa, Artificial Sequence
  Description of Artificial Sequence: Synthetic peptide
MNWRPILTII

SEQ ID NO: 1302 - protein, 9 aa, Artificial Sequence
  Description of Artificial Sequence: Synthetic peptide
NSFEVCVCA

SEQ ID NO: 1303 - protein, 9 aa, Artificial Sequence
  Description of Artificial Sequence: Synthetic peptide
NSFEVHVCA

SEQ ID NO: 1304 - protein, 9 aa, Artificial Sequence
  Description of Artificial Sequence: Synthetic peptide
VVPCEPPEV

SEQ ID NO: 1305 - protein, 10 aa, Artificial Sequence
  Description of Artificial Sequence: Synthetic peptide
VVVPCEPPEV

SEQ ID NO: 1306 - protein, 10 aa, Artificial Sequence
  Description of Artificial Sequence: Synthetic peptide
ILLPEDTPPL

SEQ ID NO: 1307 - protein, 9 aa, Artificial Sequence
  Description of Artificial Sequence: Synthetic peptide
LLPEDTPPL

SEQ ID NO: 1308 - protein, 9 aa, Artificial Sequence
  Description of Artificial Sequence: Synthetic peptide
APFRVNHAV

SEQ ID NO: 1309 - protein, 9 aa, Artificial Sequence
  Description of Artificial Sequence: Synthetic peptide
CLADVLLSV

SEQ ID NO: 1310 - protein, 10 aa, Artificial Sequence
  Description of Artificial Sequence: Synthetic peptide
FLQERNLPPK

SEQ ID NO: 1311 - protein, 10 aa, Artificial Sequence
  Description of Artificial Sequence: Synthetic peptide
HLIVLRVVRL

SEQ ID NO: 1312 - protein, 9 aa, Artificial Sequence
  Description of Artificial Sequence: Synthetic peptide
HPKVHLNTM

SEQ ID NO: 1313 - protein, 10 aa, Artificial Sequence
  Description of Artificial Sequence: Synthetic peptide
HPKVHLNTMF

SEQ ID NO: 1314 - protein, 9 aa, Artificial Sequence
  Description of Artificial Sequence: Synthetic peptide
KVHLNTMFR

SEQ ID NO: 1315 - protein, 10 aa, Artificial Sequence
  Description of Artificial Sequence: Synthetic peptide
KVHLNTMFRR

SEQ ID NO: 1316 - protein, 10 aa, Artificial Sequence
  Description of Artificial Sequence: Synthetic peptide
LPAPFRVNHA

SEQ ID NO: 1317 - protein, 9 aa, Artificial Sequence
  Description of Artificial Sequence: Synthetic peptide
MFRRPHSCL

SEQ ID NO: 1318 - protein, 10 aa, Artificial Sequence
  Description of Artificial Sequence: Synthetic peptide
MFRRPHSCLA

SEQ ID NO: 1319 - protein, 10 aa, Artificial Sequence
  Description of Artificial Sequence: Synthetic peptide
NTMFRRPHSC

SEQ ID NO: 1320 - protein, 9 aa, Artificial Sequence
  Description of Artificial Sequence: Synthetic peptide
RPHSCLADV

SEQ ID NO: 1321 - protein, 10 aa, Artificial Sequence
  Description of Artificial Sequence: Synthetic peptide
RPHSCLADVL

SEQ ID NO: 1322 - protein, 10 aa, Artificial Sequence
  Description of Artificial Sequence: Synthetic peptide
RVVRLPAPFR

SEQ ID NO: 1323 - protein, 9 aa, Artificial Sequence
  Description of Artificial Sequence: Synthetic peptide
SVHLIVLRV

SEQ ID NO: 1324 - protein, 9 aa, Artificial Sequence
  Description of Artificial Sequence: Synthetic peptide
TMFRRPHSC

SEQ ID NO: 1325 - protein, 10 aa, Artificial Sequence
  Description of Artificial Sequence: Synthetic peptide
TMFRRPHSCL

SEQ ID NO: 1326 - protein, 9 aa, Artificial Sequence
  Description of Artificial Sequence: Synthetic peptide
VLLSVHLIV

SEQ ID NO: 1327 - protein, 10 aa, Artificial Sequence
  Description of Artificial Sequence: Synthetic peptide
VLLSVHLIVL

SEQ ID NO: 1328 - protein, 9 aa, Artificial Sequence
  Description of Artificial Sequence: Synthetic peptide
VLRVVRLPA

SEQ ID NO: 1329 - protein, 9 aa, Artificial Sequence
  Description of Artificial Sequence: Synthetic peptide
VVRLPAPFR

SEQ ID NO: 1330 - protein, 10 aa, Artificial Sequence
  Description of Artificial Sequence: Synthetic peptide
AMPILPLPQL

SEQ ID NO: 1331 - protein, 10 aa, Artificial Sequence
  Description of Artificial Sequence: Synthetic peptide
APLLAAPSPA

SEQ ID NO: 1332 - protein, 9 aa, Artificial Sequence
  Description of Artificial Sequence: Synthetic peptide
APRTNFHSS

SEQ ID NO: 1333 - protein, 10 aa, Artificial Sequence
  Description of Artificial Sequence: Synthetic peptide
APRTNFHSSL

SEQ ID NO: 1334 - protein, 10 aa, Artificial Sequence
  Description of Artificial Sequence: Synthetic peptide
CPQPSPSLPA

SEQ ID NO: 1335 - protein, 9 aa, Artificial Sequence
  Description of Artificial Sequence: Synthetic peptide
GQWMAHMAL

SEQ ID NO: 1336 - protein, 10 aa, Artificial Sequence
  Description of Artificial Sequence: Synthetic peptide
GQWMAHMALL

SEQ ID NO: 1337 - protein, 10 aa, Artificial Sequence
  Description of Artificial Sequence: Synthetic peptide
HMALLPSGTK

SEQ ID NO: 1338 - protein, 9 aa, Artificial Sequence
  Description of Artificial Sequence: Synthetic peptide
HTALGRGSL

SEQ ID NO: 1339 - protein, 9 aa, Artificial Sequence
  Description of Artificial Sequence: Synthetic peptide
IPMAISSPP

SEQ ID NO: 1340 - protein, 10 aa, Artificial Sequence
  Description of Artificial Sequence: Synthetic peptide
IPMAISSPPK

SEQ ID NO: 1341 - protein, 9 aa, Artificial Sequence
  Description of Artificial Sequence: Synthetic peptide
KLPSLPLSK

SEQ ID NO: 1342 - protein, 10 aa, Artificial Sequence
  Description of Artificial Sequence: Synthetic peptide
KLPSLPLSKM

SEQ ID NO: 1343 - protein, 9 aa, Artificial Sequence
  Description of Artificial Sequence: Synthetic peptide
KMYTTSMAM

SEQ ID NO: 1344 - protein, 10 aa, Artificial Sequence
  Description of Artificial Sequence: Synthetic peptide
LLAAPSPASR

SEQ ID NO: 1345 - protein, 10 aa, Artificial Sequence
  Description of Artificial Sequence: Synthetic peptide
LLLSADQQAA

SEQ ID NO: 1346 - protein, 9 aa, Artificial Sequence
  Description of Artificial Sequence: Synthetic peptide
LLSADQQAA

SEQ ID NO: 1347 - protein, 9 aa, Artificial Sequence
  Description of Artificial Sequence: Synthetic peptide
LPASNKLPS

SEQ ID NO: 1348 - protein, 10 aa, Artificial Sequence
  Description of Artificial Sequence: Synthetic peptide
LPASNKLPSL

SEQ ID NO: 1349 - protein, 10 aa, Artificial Sequence
  Description of Artificial Sequence: Synthetic peptide
LPLPQLLLSA

SEQ ID NO: 1350 - protein, 9 aa, Artificial Sequence
  Description of Artificial Sequence: Synthetic peptide
LPSLPLSKM

SEQ ID NO: 1351 - protein, 9 aa, Artificial Sequence
  Description of Artificial Sequence: Synthetic peptide
LSKMYTTSM

SEQ ID NO: 1352 - protein, 9 aa, Artificial Sequence
  Description of Artificial Sequence: Synthetic peptide
MALLPSGTK

SEQ ID NO: 1353 - protein, 9 aa, Artificial Sequence
  Description of Artificial Sequence: Synthetic peptide
MPILPLPQL

SEQ ID NO: 1354 - protein, 10 aa, Artificial Sequence
  Description of Artificial Sequence: Synthetic peptide
MPILPLPQLL

SEQ ID NO: 1355 - protein, 10 aa, Artificial Sequence
  Description of Artificial Sequence: Synthetic peptide
MYTTSMAMPI

SEQ ID NO: 1356 - protein, 9 aa, Artificial Sequence
  Description of Artificial Sequence: Synthetic peptide
PMAISSPPK

SEQ ID NO: 1357 - protein, 9 aa, Artificial Sequence
  Description of Artificial Sequence: Synthetic peptide
QWMAHMALL

SEQ ID NO: 1358 - protein, 10 aa, Artificial Sequence
  Description of Artificial Sequence: Synthetic peptide
SKMYTTSMAM

SEQ ID NO: 1359 - protein, 9 aa, Artificial Sequence
  Description of Artificial Sequence: Synthetic peptide
SMAMPILPL

SEQ ID NO: 1360 - protein, 9 aa, Artificial Sequence
  Description of Artificial Sequence: Synthetic peptide
SNKLPSLPL

SEQ ID NO: 1361 - protein, 9 aa, Artificial Sequence
  Description of Artificial Sequence: Synthetic peptide
SPASRLQCI

SEQ ID NO: 1362 - protein, 10 aa, Artificial Sequence
  Description of Artificial Sequence: Synthetic peptide
SPPKAPLLAA

SEQ ID NO: 1363 - protein, 10 aa, Artificial Sequence
  Description of Artificial Sequence: Synthetic peptide
SPSLPASNKL

SEQ ID NO: 1364 - protein, 9 aa, Artificial Sequence
  Description of Artificial Sequence: Synthetic peptide
YTTSMAMPI

SEQ ID NO: 1365 - protein, 10 aa, Artificial Sequence
  Description of Artificial Sequence: Synthetic peptide
YTTSMAMPIL

SEQ ID NO: 1366 - protein, 9 aa, Artificial Sequence
  Description of Artificial Sequence: Synthetic peptide
CLPGLTHPA

SEQ ID NO: 1367 - protein, 10 aa, Artificial Sequence
  Description of Artificial Sequence: Synthetic peptide
GLTHPAHQPL

SEQ ID NO: 1368 - protein, 10 aa, Artificial Sequence
  Description of Artificial Sequence: Synthetic peptide
HPAHQPLGSM

SEQ ID NO: 1369 - protein, 9 aa, Artificial Sequence
  Description of Artificial Sequence: Synthetic peptide
LTHPAHQPL

SEQ ID NO: 1370 - protein, 10 aa, Artificial Sequence
  Description of Artificial Sequence: Synthetic peptide
RPTSRARQSC

SEQ ID NO: 1371 - protein, 9 aa, Artificial Sequence
  Description of Artificial Sequence: Synthetic peptide
RQSCCLPGL

SEQ ID NO: 1372 - protein, 10 aa, Artificial Sequence
  Description of Artificial Sequence: Synthetic peptide
TSRARQSCCL

SEQ ID NO: 1373 - protein, 10 aa, Artificial Sequence
  Description of Artificial Sequence: Synthetic peptide
ELLCVWVSSI

SEQ ID NO: 1374 - protein, 9 aa, Artificial Sequence
  Description of Artificial Sequence: Synthetic peptide
EWKVKFPEL

SEQ ID NO: 1375 - protein, 9 aa, Artificial Sequence
  Description of Artificial Sequence: Synthetic peptide
KFPELLCVW

SEQ ID NO: 1376 - protein, 9 aa, Artificial Sequence
  Description of Artificial Sequence: Synthetic peptide
LLCVWVSSI

SEQ ID NO: 1377 - protein, 10 aa, Artificial Sequence
  Description of Artificial Sequence: Synthetic peptide
LLTSSSREWK

SEQ ID NO: 1378 - protein, 9 aa, Artificial Sequence
  Description of Artificial Sequence: Synthetic peptide
LTSSSREWK

SEQ ID NO: 1379 - protein, 10 aa, Artificial Sequence
  Description of Artificial Sequence: Synthetic peptide
YPAYSKDSGL

SEQ ID NO: 1380 - protein, 9 aa, Artificial Sequence
  Description of Artificial Sequence: Synthetic peptide
CLQCLWALL

SEQ ID NO: 1381 - protein, 10 aa, Artificial Sequence
  Description of Artificial Sequence: Synthetic peptide
CQWGPCLQCL

SEQ ID NO: 1382 - protein, 9 aa, Artificial Sequence
  Description of Artificial Sequence: Synthetic peptide
QWGPCLQCL

SEQ ID NO: 1383 - protein, 10 aa, Artificial Sequence
  Description of Artificial Sequence: Synthetic peptide
QWGPCLQCLW

SEQ ID NO: 1384 - protein, 9 aa, Artificial Sequence
  Description of Artificial Sequence: Synthetic peptide
AIQPVLWTT

SEQ ID NO: 1385 - protein, 9 aa, Artificial Sequence
  Description of Artificial Sequence: Synthetic peptide
ALQPLQPHA

SEQ ID NO: 1386 - protein, 10 aa, Artificial Sequence
  Description of Artificial Sequence: Synthetic peptide
DLHFCRSSIM

SEQ ID NO: 1387 - protein, 9 aa, Artificial Sequence
  Description of Artificial Sequence: Synthetic peptide
EPHLALQPL

SEQ ID NO: 1388 - protein, 9 aa, Artificial Sequence
  Description of Artificial Sequence: Synthetic peptide
ESKIMFATL

SEQ ID NO: 1389 - protein, 9 aa, Artificial Sequence
  Description of Artificial Sequence: Synthetic peptide
FATLQRSSL

SEQ ID NO: 1390 - protein, 9 aa, Artificial Sequence
  Description of Artificial Sequence: Synthetic peptide
FLKAESKIM

SEQ ID NO: 1391 - protein, 10 aa, Artificial Sequence
  Description of Artificial Sequence: Synthetic peptide
FLKAESKIMF

SEQ ID NO: 1392 - protein, 9 aa, Artificial Sequence
  Description of Artificial Sequence: Synthetic peptide
GPPARVPAV

SEQ ID NO: 1393 - protein, 10 aa, Artificial Sequence
  Description of Artificial Sequence: Synthetic peptide
IMKPKRDGYM

SEQ ID NO: 1394 - protein, 9 aa, Artificial Sequence
  Description of Artificial Sequence: Synthetic peptide
KIMFATLQR

SEQ ID NO: 1395 - protein, 9 aa, Artificial Sequence
  Description of Artificial Sequence: Synthetic peptide
KPKRDGYMF

SEQ ID NO: 1396 - protein, 10 aa, Artificial Sequence
  Description of Artificial Sequence: Synthetic peptide
KPKRDGYMFL

SEQ ID NO: 1397 - protein, 9 aa, Artificial Sequence
  Description of Artificial Sequence: Synthetic peptide
LHFCRSSIM

SEQ ID NO: 1398 - protein, 9 aa, Artificial Sequence
  Description of Artificial Sequence: Synthetic peptide
LQHGHRHGL

SEQ ID NO: 1399 - protein, 10 aa, Artificial Sequence
  Description of Artificial Sequence: Synthetic peptide
MFATLQRSSL

SEQ ID NO: 1400 - protein, 9 aa, Artificial Sequence
  Description of Artificial Sequence: Synthetic peptide
MFLKAESKI

SEQ ID NO: 1401 - protein, 9 aa, Artificial Sequence
  Description of Artificial Sequence: Synthetic peptide
MLTGPPARV

SEQ ID NO: 1402 - protein, 10 aa, Artificial Sequence
  Description of Artificial Sequence: Synthetic peptide
QPVLWTTPPL

SEQ ID NO: 1403 - protein, 10 aa, Artificial Sequence
  Description of Artificial Sequence: Synthetic peptide
SMLTGPPARV

SEQ ID NO: 1404 - protein, 10 aa, Artificial Sequence
  Description of Artificial Sequence: Synthetic peptide
TLQRSSLWCL

SEQ ID NO: 1405 - protein, 9 aa, Artificial Sequence
  Description of Artificial Sequence: Synthetic peptide
VLPEPHLAL

SEQ ID NO: 1406 - protein, 10 aa, Artificial Sequence
  Description of Artificial Sequence: Synthetic peptide
VPAVPFDLHF

SEQ ID NO: 1407 - protein, 9 aa, Artificial Sequence
  Description of Artificial Sequence: Synthetic peptide
YMFLKAESK

SEQ ID NO: 1408 - protein, 10 aa, Artificial Sequence
  Description of Artificial Sequence: Synthetic peptide
YMFLKAESKI

SEQ ID NO: 1409 - protein, 9 aa, Artificial Sequence
  Description of Artificial Sequence: Synthetic peptide
APGPRGRTC

SEQ ID NO: 1410 - protein, 10 aa, Artificial Sequence
  Description of Artificial Sequence: Synthetic peptide
CLRSHTCPPR

SEQ ID NO: 1411 - protein, 10 aa, Artificial Sequence
  Description of Artificial Sequence: Synthetic peptide
CLWCHACLHR

SEQ ID NO: 1412 - protein, 9 aa, Artificial Sequence
  Description of Artificial Sequence: Synthetic peptide
CPHLGSHPC

SEQ ID NO: 1413 - protein, 9 aa, Artificial Sequence
  Description of Artificial Sequence: Synthetic peptide
CPLGLKSPL

SEQ ID NO: 1414 - protein, 9 aa, Artificial Sequence
  Description of Artificial Sequence: Synthetic peptide
CPRSCRCPH

SEQ ID NO: 1415 - protein, 10 aa, Artificial Sequence
  Description of Artificial Sequence: Synthetic peptide
CPRSCRCPHL

SEQ ID NO: 1416 - protein, 10 aa, Artificial Sequence
  Description of Artificial Sequence: Synthetic peptide
CSLPLGNHPY

SEQ ID NO: 1417 - protein, 9 aa, Artificial Sequence
  Description of Artificial Sequence: Synthetic peptide
GLRNRICPL

SEQ ID NO: 1418 - protein, 9 aa, Artificial Sequence
  Description of Artificial Sequence: Synthetic peptide
GLRSHTYLR

SEQ ID NO: 1419 - protein, 10 aa, Artificial Sequence
  Description of Artificial Sequence: Synthetic peptide
GLRSHTYLRR

SEQ ID NO: 1420 - protein, 10 aa, Artificial Sequence
  Description of Artificial Sequence: Synthetic peptide
GPRGRTCHPG

SEQ ID NO: 1421 - protein, 9 aa, Artificial Sequence
  Description of Artificial Sequence: Synthetic peptide
HLGSHPCRL

SEQ ID NO: 1422 - protein, 9 aa, Artificial Sequence
  Description of Artificial Sequence: Synthetic peptide
HLRLHASPH

SEQ ID NO: 1423 - protein, 9 aa, Artificial Sequence
  Description of Artificial Sequence: Synthetic peptide
HLRSCPCSL

SEQ ID NO: 1424 - protein, 9 aa, Artificial Sequence
  Description of Artificial Sequence: Synthetic peptide
HLRTHLLPH

SEQ ID NO: 1425 - protein, 10 aa, Artificial Sequence
  Description of Artificial Sequence: Synthetic peptide
HLRTHLLPHH

SEQ ID NO: 1426 - protein, 9 aa, Artificial Sequence
  Description of Artificial Sequence: Synthetic peptide
HLRYRAYPP

SEQ ID NO: 1427 - protein, 10 aa, Artificial Sequence
  Description of Artificial Sequence: Synthetic peptide
HLRYRAYPPC

SEQ ID NO: 1428 - protein, 9 aa, Artificial Sequence
  Description of Artificial Sequence: Synthetic peptide
HPHHLRTHL

SEQ ID NO: 1429 - protein, 10 aa, Artificial Sequence
  Description of Artificial Sequence: Synthetic peptide
HPHHLRTHLL

SEQ ID NO: 1430 - protein, 10 aa, Artificial Sequence
  Description of Artificial Sequence: Synthetic peptide
HTYLRRLRSH

SEQ ID NO: 1431 - protein, 10 aa, Artificial Sequence
  Description of Artificial Sequence: Synthetic peptide
LPCPHRLRSL

SEQ ID NO: 1432 - protein, 10 aa, Artificial Sequence
  Description of Artificial Sequence: Synthetic peptide
LPHHRRTRSC

SEQ ID NO: 1433 - protein, 9 aa, Artificial Sequence
  Description of Artificial Sequence: Synthetic peptide
LPLGNHPYL

SEQ ID NO: 1434 - protein, 9 aa, Artificial Sequence
  Description of Artificial Sequence: Synthetic peptide
LPRPLHLRL

SEQ ID NO: 1435 - protein, 9 aa, Artificial Sequence
  Description of Artificial Sequence: Synthetic peptide
NLRNHTCPP

SEQ ID NO: 1436 - protein, 10 aa, Artificial Sequence
  Description of Artificial Sequence: Synthetic peptide
PPRLRSRTCL

SEQ ID NO: 1437 - protein, 9 aa, Artificial Sequence
  Description of Artificial Sequence: Synthetic peptide
RLHASPHHL

SEQ ID NO: 1438 - protein, 10 aa, Artificial Sequence
  Description of Artificial Sequence: Synthetic peptide
RLHASPHHLR

SEQ ID NO: 1439 - protein, 9 aa, Artificial Sequence
  Description of Artificial Sequence: Synthetic peptide
RLRDHICPL

SEQ ID NO: 1440 - protein, 9 aa, Artificial Sequence
  Description of Artificial Sequence: Synthetic peptide
RLRNLPCPH

SEQ ID NO: 1441 - protein, 10 aa, Artificial Sequence
  Description of Artificial Sequence: Synthetic peptide
RLRNLPCPHR

SEQ ID NO: 1442 - protein, 9 aa, Artificial Sequence
  Description of Artificial Sequence: Synthetic peptide
RLRSHTCPP

SEQ ID NO: 1443 - protein, 9 aa, Artificial Sequence
  Description of Artificial Sequence: Synthetic peptide
RLRSLPRPL

SEQ ID NO: 1444 - protein, 10 aa, Artificial Sequence
  Description of Artificial Sequence: Synthetic peptide
RLRSLPRPLH

SEQ ID NO: 1445 - protein, 9 aa, Artificial Sequence
  Description of Artificial Sequence: Synthetic peptide
RLRSRTCLL

SEQ ID NO: 1446 - protein, 9 aa, Artificial Sequence
  Description of Artificial Sequence: Synthetic peptide
RNRICPLSL

SEQ ID NO: 1447 - protein, 9 aa, Artificial Sequence
  Description of Artificial Sequence: Synthetic peptide
RPLHLRLHA

SEQ ID NO: 1448 - protein, 10 aa, Artificial Sequence
  Description of Artificial Sequence: Synthetic peptide
RPLHLRLHAS

SEQ ID NO: 1449 - protein, 10 aa, Artificial Sequence
  Description of Artificial Sequence: Synthetic peptide
RSHACPPGLR

SEQ ID NO: 1450 - protein, 10 aa, Artificial Sequence
  Description of Artificial Sequence: Synthetic peptide
RSHACPPNLR

SEQ ID NO: 1451 - protein, 10 aa, Artificial Sequence
  Description of Artificial Sequence: Synthetic peptide
RSHAYALCLR

SEQ ID NO: 1452 - protein, 10 aa, Artificial Sequence
  Description of Artificial Sequence: Synthetic peptide
RSHPCCHYLR

SEQ ID NO: 1453 - protein, 10 aa, Artificial Sequence
  Description of Artificial Sequence: Synthetic peptide
RSHPCPLGLK

SEQ ID NO: 1454 - protein, 10 aa, Artificial Sequence
  Description of Artificial Sequence: Synthetic peptide
RSHTCPPSLR

SEQ ID NO: 1455 - protein, 10 aa, Artificial Sequence
  Description of Artificial Sequence: Synthetic peptide
RSLPRPLHLR

SEQ ID NO: 1456 - protein, 9 aa, Artificial Sequence
  Description of Artificial Sequence: Synthetic peptide
RSRTCLLCL

SEQ ID NO: 1457 - protein, 10 aa, Artificial Sequence
  Description of Artificial Sequence: Synthetic peptide
RSRTCLLCLR

SEQ ID NO: 1458 - protein, 9 aa, Artificial Sequence
  Description of Artificial Sequence: Synthetic peptide
RSRTCPPGL

SEQ ID NO: 1459 - protein, 10 aa, Artificial Sequence
  Description of Artificial Sequence: Synthetic peptide
RSRTCPPGLR

SEQ ID NO: 1460 - protein, 10 aa, Artificial Sequence
  Description of Artificial Sequence: Synthetic peptide
RTHLLPHHRR

SEQ ID NO: 1461 - protein, 10 aa, Artificial Sequence
  Description of Artificial Sequence: Synthetic peptide
RTRSCPCRWR

SEQ ID NO: 1462 - protein, 9 aa, Artificial Sequence
  Description of Artificial Sequence: Synthetic peptide
RYRAYPPCL

SEQ ID NO: 1463 - protein, 10 aa, Artificial Sequence
  Description of Artificial Sequence: Synthetic peptide
RYRAYPPCLW

SEQ ID NO: 1464 - protein, 9 aa, Artificial Sequence
  Description of Artificial Sequence: Synthetic peptide
SLGNHLCPL

SEQ ID NO: 1465 - protein, 10 aa, Artificial Sequence
  Description of Artificial Sequence: Synthetic peptide
SLPLGNHPYL

SEQ ID NO: 1466 - protein, 10 aa, Artificial Sequence
  Description of Artificial Sequence: Synthetic peptide
SLPRPLHLRL

SEQ ID NO: 1467 - protein, 10 aa, Artificial Sequence
  Description of Artificial Sequence: Synthetic peptide
SLRNCTCPPR

SEQ ID NO: 1468 - protein, 9 aa, Artificial Sequence
  Description of Artificial Sequence: Synthetic peptide
SLRSHAYAL

SEQ ID NO: 1469 - protein, 9 aa, Artificial Sequence
  Description of Artificial Sequence: Synthetic peptide
SLRSHPCPL

SEQ ID NO: 1470 - protein, 9 aa, Artificial Sequence
  Description of Artificial Sequence: Synthetic peptide
SPHHLRTPP

SEQ ID NO: 1471 - protein, 10 aa, Artificial Sequence
  Description of Artificial Sequence: Synthetic peptide
SPHHLRTPPH

SEQ ID NO: 1472 - protein, 10 aa, Artificial Sequence
  Description of Artificial Sequence: Synthetic peptide
SPLRSQANAL

SEQ ID NO: 1473 - protein, 10 aa, Artificial Sequence
  Description of Artificial Sequence: Synthetic peptide
YLRRLRSHTC

SEQ ID NO: 1474 - protein, 9 aa, Artificial Sequence
  Description of Artificial Sequence: Synthetic peptide
YLRSRNSAP

SEQ ID NO: 1475 - protein, 10 aa, Artificial Sequence
  Description of Artificial Sequence: Synthetic peptide
YLRSRNSAPG

SEQ ID NO: 1476 - protein, 9 aa, Artificial Sequence
  Description of Artificial Sequence: Synthetic peptide
ALAPTLTHM

SEQ ID NO: 1477 - protein, 10 aa, Artificial Sequence
  Description of Artificial Sequence: Synthetic peptide
ALAPTLTHML

SEQ ID NO: 1478 - protein, 10 aa, Artificial Sequence
  Description of Artificial Sequence: Synthetic peptide
LLQVTQTSFA

SEQ ID NO: 1479 - protein, 10 aa, Artificial Sequence
  Description of Artificial Sequence: Synthetic peptide
LQVTQTSFAL

SEQ ID NO: 1480 - protein, 9 aa, Artificial Sequence
  Description of Artificial Sequence: Synthetic peptide
RLWHLLLQV

SEQ ID NO: 1481 - protein, 10 aa, Artificial Sequence
  Description of Artificial Sequence: Synthetic peptide
RLWHLLLQVT

SEQ ID NO: 1482 - protein, 10 aa, Artificial Sequence
  Description of Artificial Sequence: Synthetic peptide
CTQLARFFPI

SEQ ID NO: 1483 - protein, 9 aa, Artificial Sequence
  Description of Artificial Sequence: Synthetic peptide
FFPITPPVW

SEQ ID NO: 1484 - protein, 10 aa, Artificial Sequence
  Description of Artificial Sequence: Synthetic peptide
FPITPPVWHI

SEQ ID NO: 1485 - protein, 10 aa, Artificial Sequence
  Description of Artificial Sequence: Synthetic peptide
GPRMQLCTQL

SEQ ID NO: 1486 - protein, 9 aa, Artificial Sequence
  Description of Artificial Sequence: Synthetic peptide
ITPPVWHIL

SEQ ID NO: 1487 - protein, 9 aa, Artificial Sequence
  Description of Artificial Sequence: Synthetic peptide
LALGPRMQL

SEQ ID NO: 1488 - protein, 10 aa, Artificial Sequence
  Description of Artificial Sequence: Synthetic peptide
MQLCTQLARF

SEQ ID NO: 1489 - protein, 9 aa, Artificial Sequence
  Description of Artificial Sequence: Synthetic peptide
RFFPITPPV

SEQ ID NO: 1490 - protein, 10 aa, Artificial Sequence
  Description of Artificial Sequence: Synthetic peptide
RFFPITPPVW

SEQ ID NO: 1491 - protein, 9 aa, Artificial Sequence
  Description of Artificial Sequence: Synthetic peptide
RMQLCTQLA

SEQ ID NO: 1492 - protein, 10 aa, Artificial Sequence
  Description of Artificial Sequence: Synthetic peptide
RMQLCTQLAR

SEQ ID NO: 1493 - protein, 10 aa, Artificial Sequence
  Description of Artificial Sequence: Synthetic peptide
SPPLALGPRM

SEQ ID NO: 1494 - protein, 9 aa, Artificial Sequence
  Description of Artificial Sequence: Synthetic peptide
TQLARFFPI

SEQ ID NO: 1495 - protein, 9 aa, Artificial Sequence
  Description of Artificial Sequence: Synthetic peptide
KSRQNHLQL

SEQ ID NO: 1496 - protein, 9 aa, Artificial Sequence
  Description of Artificial Sequence: Synthetic peptide
ALKKLRSPL

SEQ ID NO: 1497 - protein, 10 aa, Artificial Sequence
  Description of Artificial Sequence: Synthetic peptide
HLQLKSCRRK

SEQ ID NO: 1498 - protein, 9 aa, Artificial Sequence
  Description of Artificial Sequence: Synthetic peptide
KISNWSLKK

SEQ ID NO: 1499 - protein, 10 aa, Artificial Sequence
  Description of Artificial Sequence: Synthetic peptide
KISNWSLKKV

SEQ ID NO: 1500 - protein, 9 aa, Artificial Sequence
  Description of Artificial Sequence: Synthetic peptide
KLRSPLWIF

SEQ ID NO: 1501 - protein, 10 aa, Artificial Sequence
  Description of Artificial Sequence: Synthetic peptide
KSRQNHLQLK

SEQ ID NO: 1502 - protein, 10 aa, Artificial Sequence
  Description of Artificial Sequence: Synthetic peptide
NWSLKKVPAL

SEQ ID NO: 1503 - protein, 9 aa, Artificial Sequence
  Description of Artificial Sequence: Synthetic peptide
SLKKVPALK

SEQ ID NO: 1504 - protein, 10 aa, Artificial Sequence
  Description of Artificial Sequence: Synthetic peptide
SLKKVPALKK

SEQ ID NO: 1505 - protein, 9 aa, Artificial Sequence
  Description of Artificial Sequence: Synthetic peptide
SQKSRQNHL

SEQ ID NO: 1506 - protein, 9 aa, Artificial Sequence
  Description of Artificial Sequence: Synthetic peptide
WSLKKVPAL

SEQ ID NO: 1507 - protein, 10 aa, Artificial Sequence
  Description of Artificial Sequence: Synthetic peptide
WSLKKVPALK

SEQ ID NO: 1508 - protein, 9 aa, Artificial Sequence
  Description of Artificial Sequence: Synthetic peptide
KLPECQRLL

SEQ ID NO: 1509 - protein, 10 aa, Artificial Sequence
  Description of Artificial Sequence: Synthetic peptide
KPTRAATVSV

SEQ ID NO: 1510 - protein, 10 aa, Artificial Sequence
  Description of Artificial Sequence: Synthetic peptide
LPPWPLHQQL

SEQ ID NO: 1511 - protein, 9 aa, Artificial Sequence
  Description of Artificial Sequence: Synthetic peptide
LPRKPTRAA

SEQ ID NO: 1512 - protein, 10 aa, Artificial Sequence
  Description of Artificial Sequence: Synthetic peptide
LPRKPTRAAT

SEQ ID NO: 1513 - protein, 9 aa, Artificial Sequence
  Description of Artificial Sequence: Synthetic peptide
QQLLHRRPL

SEQ ID NO: 1514 - protein, 9 aa, Artificial Sequence
  Description of Artificial Sequence: Synthetic peptide
RLLPPWPLH

SEQ ID NO: 1515 - protein, 10 aa, Artificial Sequence
  Description of Artificial Sequence: Synthetic peptide
APASAPWPST

SEQ ID NO: 1516 - protein, 9 aa, Artificial Sequence
  Description of Artificial Sequence: Synthetic peptide
APWPSTSSH

SEQ ID NO: 1517 - protein, 9 aa, Artificial Sequence
  Description of Artificial Sequence: Synthetic peptide
RPAPASAPW

SEQ ID NO: 1518 - protein, 9 aa, Artificial Sequence
  Description of Artificial Sequence: Synthetic peptide
WPSTSSHST

SEQ ID NO: 1519 - protein, 9 aa, Artificial Sequence
  Description of Artificial Sequence: Synthetic peptide
RVQNQGHLL

SEQ ID NO: 1520 - protein, 10 aa, Artificial Sequence
  Description of Artificial Sequence: Synthetic peptide
FLPISHCQCI

SEQ ID NO: 1521 - protein, 9 aa, Artificial Sequence
  Description of Artificial Sequence: Synthetic peptide
FWLTKLNYL

SEQ ID NO: 1522 - protein, 9 aa, Artificial Sequence
  Description of Artificial Sequence: Synthetic peptide
HLSMLTDSL

SEQ ID NO: 1523 - protein, 9 aa, Artificial Sequence
  Description of Artificial Sequence: Synthetic peptide
HTMGFWLTK

SEQ ID NO: 1524 - protein, 10 aa, Artificial Sequence
  Description of Artificial Sequence: Synthetic peptide
HTMGFWLTKL

SEQ ID NO: 1525 - protein, 10 aa, Artificial Sequence
  Description of Artificial Sequence: Synthetic peptide
KLNYLCHLSM

SEQ ID NO: 1526 - protein, 9 aa, Artificial Sequence
  Description of Artificial Sequence: Synthetic peptide
LPISHCQCI

SEQ ID NO: 1527 - protein, 10 aa, Artificial Sequence
  Description of Artificial Sequence: Synthetic peptide
LPISHCQCIL

SEQ ID NO: 1528 - protein, 9 aa, Artificial Sequence
  Description of Artificial Sequence: Synthetic peptide
LTDSLFLPI

SEQ ID NO: 1529 - protein, 10 aa, Artificial Sequence
  Description of Artificial Sequence: Synthetic peptide
LTKLNYLCHL

SEQ ID NO: 1530 - protein, 10 aa, Artificial Sequence
  Description of Artificial Sequence: Synthetic peptide
MLTDSLFLPI

SEQ ID NO: 1531 - protein, 10 aa, Artificial Sequence
  Description of Artificial Sequence: Synthetic peptide
MQGHTMGFWL

SEQ ID NO: 1532 - protein, 9 aa, Artificial Sequence
  Description of Artificial Sequence: Synthetic peptide
NYLCHLSML

SEQ ID NO: 1533 - protein, 9 aa, Artificial Sequence
  Description of Artificial Sequence: Synthetic peptide
SMLTDSLFL

SEQ ID NO: 1534 - protein, 9 aa, Artificial Sequence
  Description of Artificial Sequence: Synthetic peptide
TMGFWLTKL

SEQ ID NO: 1535 - protein, 9 aa, Artificial Sequence
  Description of Artificial Sequence: Synthetic peptide
YLCHLSMLT

SEQ ID NO: 1536 - protein, 10 aa, Artificial Sequence
  Description of Artificial Sequence: Synthetic peptide
ILDEAYVMAY

SEQ ID NO: 1537 - protein, 9 aa, Artificial Sequence
  Description of Artificial Sequence: Synthetic peptide
VMAYVMAGV

SEQ ID NO: 1538 - protein, 9 aa, Artificial Sequence
  Description of Artificial Sequence: Synthetic peptide
YVMAYVMAG

SEQ ID NO: 1539 - protein, 10 aa, Artificial Sequence
  Description of Artificial Sequence: Synthetic peptide
YVMAYVMAGV

SEQ ID NO: 1540 - protein, 62 aa, Artificial Sequence; identical to SEQ ID NO: 1213
  Description of Artificial Sequence: Synthetic polypeptide

SEQ ID NO: 1541 - protein, 10 aa, Artificial Sequence
  Description of Artificial Sequence: Synthetic peptide
KLVVVGACGV

SEQ ID NO: 1542 - protein, 9 aa, Artificial Sequence
  Description of Artificial Sequence: Synthetic peptide
LVVVGACGV

SEQ ID NO: 1543 - protein, 9 aa, Artificial Sequence
  Description of Artificial Sequence: Synthetic peptide
VVGACGVGK

SEQ ID NO: 1544 - protein, 10 aa, Artificial Sequence
  Description of Artificial Sequence: Synthetic peptide
VVVGACGVGK

SEQ ID NO: 1545 - protein, 62 aa, Artificial Sequence; identical to SEQ ID NO: 1214
  Description of Artificial Sequence: Synthetic polypeptide

SEQ ID NO: 1546 - protein, 9 aa, Artificial Sequence
  Description of Artificial Sequence: Synthetic peptide
VVGADGVGK

SEQ ID NO: 1547 - protein, 10 aa, Artificial Sequence
  Description of Artificial Sequence: Synthetic peptide
VVVGADGVGK

SEQ ID NO: 1548 - protein, 10 aa, Artificial Sequence
  Description of Artificial Sequence: Synthetic peptide
KLVVVGADGV

SEQ ID NO: 1549 - protein, 9 aa, Artificial Sequence
  Description of Artificial Sequence: Synthetic peptide
LVVVGADGV

SEQ ID NO: 1550 - protein, 62 aa, Artificial Sequence; identical to SEQ ID NO: 1215
  Description of Artificial Sequence: Synthetic polypeptide

SEQ ID NO: 1551 - protein, 10 aa, Artificial Sequence
  Description of Artificial Sequence: Synthetic peptide
KLVVVGAVGV

SEQ ID NO: 1552 - protein, 9 aa, Artificial Sequence
  Description of Artificial Sequence: Synthetic peptide
LVVVGAVGV

SEQ ID NO: 1553 - protein, 9 aa, Artificial Sequence
  Description of Artificial Sequence: Synthetic peptide
VVGAVGVGK

SEQ ID NO: 1554 - protein, 10 aa, Artificial Sequence
  Description of Artificial Sequence: Synthetic peptide
VVVGAVGVGK

SEQ ID NO: 1555 - protein, 101 aa, Artificial Sequence; identical to SEQ ID NO: 1216
  Description of Artificial Sequence: Synthetic polypeptide

SEQ ID NO: 1556 - protein, 10 aa, Artificial Sequence
  Description of Artificial Sequence: Synthetic peptide
ILDTAGHEEY

SEQ ID NO: 1557 - protein, 101 aa, Artificial Sequence; identical to SEQ ID NO: 1217
  Description of Artificial Sequence: Synthetic polypeptide

SEQ ID NO: 1558 - protein, 10 aa, Artificial Sequence
  Description of Artificial Sequence: Synthetic peptide
ILDTAGLEEY

SEQ ID NO: 1559 - protein, 10 aa, Artificial Sequence
  Description of Artificial Sequence: Synthetic peptide
LLDILDTAGL

SEQ ID NO: 1560 - protein, 101 aa, Artificial Sequence; identical to SEQ ID NO: 1218
  Description of Artificial Sequence: Synthetic polypeptide

SEQ ID NO: 1561 - protein, 10 aa, Artificial Sequence
  Description of Artificial Sequence: Synthetic peptide
ILDTAGKEEY

SEQ ID NO: 1562 - protein, 101 aa, Artificial Sequence; identical to SEQ ID NO: 1219
  Description of Artificial Sequence: Synthetic polypeptide

SEQ ID NO: 1563 - protein, 10 aa, Artificial Sequence
  Description of Artificial Sequence: Synthetic peptide
ILDTAGREEY

SEQ ID NO: 1564 - protein, 64 aa, Artificial Sequence
  Description of Artificial Sequence: Synthetic polypeptide
MALNSEALSVVSEDQSLFECAYGTPHLAKTEMTASSSSDYGQTSKMSPRVPQQDWALNSEALSV

SEQ ID NO: 1565 - protein, 10 aa, Artificial Sequence
  Description of Artificial Sequence: Synthetic peptide
ALNSEALSVV

SEQ ID NO: 1566 - protein, 10 aa, Artificial Sequence
  Description of Artificial Sequence: Synthetic peptide
MALNSEALSV

SEQ ID NO: 1567 - protein, 23 aa, Artificial Sequence
  Description of Artificial Sequence: Synthetic peptide
TCLLDILDTAGHEEYSAMRDQYM

SEQ ID NO: 1568 - protein, 10 aa, Artificial Sequence
  Description of Artificial Sequence: Synthetic peptide
ILDTAGHEEY

SEQ ID NO: 1569 - protein, 10 aa, Artificial Sequence
  Description of Artificial Sequence: Synthetic peptide
ILDTAGHEEY

SEQ ID NO: 1570 - protein, 11 aa, Artificial Sequence
  Description of Artificial Sequence: Synthetic peptide
DTAGHEEYSAM

SEQ ID NO: 1571 - protein, 11 aa, Artificial Sequence
  Description of Artificial Sequence: Synthetic peptide
DTAGHEEYSAM

SEQ ID NO: 1572 - protein, 8 aa, Artificial Sequence
  Description of Artificial Sequence: Synthetic peptide
GHEEYSAM

SEQ ID NO: 1573 - protein, 8 aa, Artificial Sequence
  Description of Artificial Sequence: Synthetic peptide
DTAGHEEY

SEQ ID NO: 1574 - protein, 9 aa, Artificial Sequence
  Description of Artificial Sequence: Synthetic peptide
ILDTAGHEE

SEQ ID NO: 1575 - protein, 9 aa, Artificial Sequence
  Description of Artificial Sequence: Synthetic peptide
AGHEEYSAM

SEQ ID NO: 1576 - protein, 9 aa, Artificial Sequence
  Description of Artificial Sequence: Synthetic peptide
AGHEEYSAM

SEQ ID NO: 1577 - protein, 8 aa, Artificial Sequence
  Description of Artificial Sequence: Synthetic peptide
DTAGHEEY

SEQ ID NO: 1578 - protein, 8 aa, Artificial Sequence
  Description of Artificial Sequence: Synthetic peptide
DTAGHEEY

SEQ ID NO: 1579 - protein, 8 aa, Artificial Sequence
  Description of Artificial Sequence: Synthetic peptide
DTAGHEEY

SEQ ID NO: 1580 - protein, 8 aa, Artificial Sequence
  Description of Artificial Sequence: Synthetic peptide
DTAGHEEY

SEQ ID NO: 1581 - protein, 9 aa, Artificial Sequence
  Description of Artificial Sequence: Synthetic peptide
ILDTAGHEE

SEQ ID NO: 1582 - protein, 9 aa, Artificial Sequence
  Description of Artificial Sequence: Synthetic peptide
ILDTAGHEE

SEQ ID NO: 1583 - protein, 10 aa, Artificial Sequence
  Description of Artificial Sequence: Synthetic peptide
ILDTAGHEEY

SEQ ID NO: 1584 - protein, 10 aa, Artificial Sequence
  Description of Artificial Sequence: Synthetic peptide
ILDTAGHEEY

SEQ ID NO: 1585 - protein, 9 aa, Artificial Sequence
  Description of Artificial Sequence: Synthetic peptide
HEEYSAMRD

SEQ ID NO: 1586 - protein, 9 aa, Artificial Sequence
  Description of Artificial Sequence: Synthetic peptide
TAGHEEYSA

SEQ ID NO: 1587 - protein, 9 aa, Artificial Sequence
  Description of Artificial Sequence: Synthetic peptide
DTAGHEEYS

SEQ ID NO: 1588 - protein, 12 aa, Artificial Sequence
  Description of Artificial Sequence: Synthetic peptide
DTAGHEEYSAMR

SEQ ID NO: 1589 - protein, 8 aa, Artificial Sequence
  Description of Artificial Sequence: Synthetic peptide
GHEEYSAM

SEQ ID NO: 1590 - protein, 9 aa, Artificial Sequence
  Description of Artificial Sequence: Synthetic peptide
ILDTAGHEE

SEQ ID NO: 1591 - protein, 9 aa, Artificial Sequence
  Description of Artificial Sequence: Synthetic peptide
LDTAGHEEY

SEQ ID NO: 1592 - protein, 9 aa, Artificial Sequence
  Description of Artificial Sequence: Synthetic peptide
HEEYSAMRD

SEQ ID NO: 1593 - protein, 9 aa, Artificial Sequence
  Description of Artificial Sequence: Synthetic peptide
ILDTAGHEE

SEQ ID NO: 1594 - protein, 8 aa, Artificial Sequence
  Description of Artificial Sequence: Synthetic peptide
DTAGHEEY

SEQ ID NO: 1595 - protein, 10 aa, Artificial Sequence
  Description of Artificial Sequence: Synthetic peptide
LLDILDTAGH

SEQ ID NO: 1596 - protein, 10 aa, Artificial Sequence
  Description of Artificial Sequence: Synthetic peptide
TAGHEEYSAM

SEQ ID NO: 1597 - protein, 9 aa, Artificial Sequence
  Description of Artificial Sequence: Synthetic peptide
LDTAGHEEY

SEQ ID NO: 1598 - protein, 9 aa, Artificial Sequence
  Description of Artificial Sequence: Synthetic peptide
DILDTAGHE

SEQ ID NO: 1599 - protein, 8 aa, Artificial Sequence
  Description of Artificial Sequence: Synthetic peptide
DTAGHEEY

SEQ ID NO: 1600 - protein, 10 aa, Artificial Sequence
  Description of Artificial Sequence: Synthetic peptide
ILDTAGHEEY

SEQ ID NO: 1601 - protein, 9 aa, Artificial Sequence
  Description of Artificial Sequence: Synthetic peptide
AGHEEYSAM

SEQ ID NO: 1602 - protein, 11 aa, Artificial Sequence
  Description of Artificial Sequence: Synthetic peptide
DILDTAGHEEY

SEQ ID NO: 1603 - protein, 8 aa, Artificial Sequence
  Description of Artificial Sequence: Synthetic peptide
DTAGHEEY

SEQ ID NO: 1604 - protein, 9 aa, Artificial Sequence
  Description of Artificial Sequence: Synthetic peptide
ILDTAGHEE

SEQ ID NO: 1605 - protein, 8 aa, Artificial Sequence
  Description of Artificial Sequence: Synthetic peptide
DILDTAGH

SEQ ID NO: 1606 - protein, 9 aa, Artificial Sequence
  Description of Artificial Sequence: Synthetic peptide
ILDTAGHEE

SEQ ID NO: 1607 - protein, 9 aa, Artificial Sequence
  Description of Artificial Sequence: Synthetic peptide
LDTAGHEEY

SEQ ID NO: 1608 - protein, 8 aa, Artificial Sequence
  Description of Artificial Sequence: Synthetic peptide
ILDTAGHE

SEQ ID NO: 1609 - protein, 9 aa, Artificial Sequence
  Description of Artificial Sequence: Synthetic peptide
LDTAGHEEY

SEQ ID NO: 1610 - protein, 9 aa, Artificial Sequence
  Description of Artificial Sequence: Synthetic peptide
AGHEEYSAM

SEQ ID NO: 1611 - protein, 11 aa, Artificial Sequence
  Description of Artificial Sequence: Synthetic peptide
DILDTAGHEEY

SEQ ID NO: 1612 - protein, 9 aa, Artificial Sequence
  Description of Artificial Sequence: Synthetic peptide
DTAGHEEYS

SEQ ID NO: 1613 - protein, 10 aa, Artificial Sequence
  Description of Artificial Sequence: Synthetic peptide
ILDTAGHEEY

SEQ ID NO: 1614 - protein, 10 aa, Artificial Sequence
  Description of Artificial Sequence: Synthetic peptide
DTAGHEEYSA

SEQ ID NO: 1615 - protein, 8 aa, Artificial Sequence
  Description of Artificial Sequence: Synthetic peptide
ILDTAGHE

SEQ ID NO: 1616 - protein, 10 aa, Artificial Sequence
  Description of Artificial Sequence: Synthetic peptide
ILDTAGHEEY

SEQ ID NO: 1617 - protein, 10 aa, Artificial Sequence
  Description of Artificial Sequence: Synthetic peptide
ILDTAGHEEY

SEQ ID NO: 1618 - protein, 9 aa, Artificial Sequence
  Description of Artificial Sequence: Synthetic peptide
LDTAGHEEY

SEQ ID NO: 1619 - protein, 9 aa, Artificial Sequence
  Description of Artificial Sequence: Synthetic peptide
AGHEEYSAM

SEQ ID NO: 1620 - protein, 9 aa, Artificial Sequence
  Description of Artificial Sequence: Synthetic peptide
AGHEEYSAM

SEQ ID NO: 1621 - protein, 10 aa, Artificial Sequence
  Description of Artificial Sequence: Synthetic peptide
LLDILDTAGH

SEQ ID NO: 1622 - protein, 23 aa, Artificial Sequence
  Description of Artificial Sequence: Synthetic peptide
TCLLDILDTAGREEYSAMRDQYM

SEQ ID NO: 1623 - protein, 10 aa, Artificial Sequence
  Description of Artificial Sequence: Synthetic peptide
ILDTAGREEY

SEQ ID NO: 1624 - protein, 10 aa, Artificial Sequence
  Description of Artificial Sequence: Synthetic peptide
ILDTAGREEY

SEQ ID NO: 1625 - protein, 11 aa, Artificial Sequence
  Description of Artificial Sequence: Synthetic peptide
DTAGREEYSAM

SEQ ID NO: 1626 - protein, 8 aa, Artificial Sequence
  Description of Artificial Sequence: Synthetic peptide
DILDTAGR

SEQ ID NO: 1627 - protein, 8 aa, Artificial Sequence
  Description of Artificial Sequence: Synthetic peptide
DILDTAGR

SEQ ID NO: 1628 - protein, 8 aa, Artificial Sequence
  Description of Artificial Sequence: Synthetic peptide
DTAGREEY

SEQ ID NO: 1629 - protein, 11 aa, Artificial Sequence
  Description of Artificial Sequence: Synthetic peptide
DTAGREEYSAM

SEQ ID NO: 1630 - protein, 11 aa, Artificial Sequence
  Description of Artificial Sequence: Synthetic peptide
CLLDILDTAGR

SEQ ID NO: 1631 - protein, 8 aa, Artificial Sequence
  Description of Artificial Sequence: Synthetic peptide
DTAGREEY

SEQ ID NO: 1632 - protein, 9 aa, Artificial Sequence
  Description of Artificial Sequence: Synthetic peptide
REEYSAMRD

SEQ ID NO: 1633 - protein, 9 aa, Artificial Sequence
  Description of Artificial Sequence: Synthetic peptide
GREEYSAMR

SEQ ID NO: 1634 - protein, 9 aa, Artificial Sequence
  Description of Artificial Sequence: Synthetic peptide
ILDTAGREE

SEQ ID NO: 1635 - protein, 10 aa, Artificial Sequence
  Description of Artificial Sequence: Synthetic peptide
ILDTAGREEY

SEQ ID NO: 1636 - protein, 9 aa, Artificial Sequence
  Description of Artificial Sequence: Synthetic peptide
REEYSAMRD

SEQ ID NO: 1637 - protein, 9 aa, Artificial Sequence
  Description of Artificial Sequence: Synthetic peptide
AGREEYSAM

SEQ ID NO: 1638 - protein, 8 aa, Artificial Sequence
  Description of Artificial Sequence: Synthetic peptide
DTAGREEY

SEQ ID NO: 1639 - protein, 8 aa, Artificial Sequence
  Description of Artificial Sequence: Synthetic peptide
DTAGREEY

SEQ ID NO: 1640 - protein, 8 aa, Artificial Sequence
  Description of Artificial Sequence: Synthetic peptide
DTAGREEY

SEQ ID NO: 1641 - protein, 8 aa, Artificial Sequence
  Description of Artificial Sequence: Synthetic peptide
DILDTAGR

SEQ ID NO: 1642 - protein, 9 aa, Artificial Sequence
  Description of Artificial Sequence: Synthetic peptide
DILDTAGRE

SEQ ID NO: 1643 - protein, 9 aa, Artificial Sequence
  Description of Artificial Sequence: Synthetic peptide
ILDTAGREE

SEQ ID NO: 1644 - protein, 8 aa, Artificial Sequence
  Description of Artificial Sequence: Synthetic peptide
DILDTAGR

SEQ ID NO: 1645 - protein, 8 aa, Artificial Sequence
  Description of Artificial Sequence: Synthetic peptide
GREEYSAM

SEQ ID NO: 1646 - protein, 9 aa, Artificial Sequence
  Description of Artificial Sequence: Synthetic peptide
AGREEYSAM

SEQ ID NO: 1647 - protein, 8 aa, Artificial Sequence
  Description of Artificial Sequence: Synthetic peptide
GREEYSAM

SEQ ID NO: 1648 - protein, 9 aa, Artificial Sequence
  Description of Artificial Sequence: Synthetic peptide
ILDTAGREE

SEQ ID NO: 1649 - protein, 9 aa, Artificial Sequence
  Description of Artificial Sequence: Synthetic peptide
TAGREEYSA

SEQ ID NO: 1650 - protein, 10 aa, Artificial Sequence
  Description of Artificial Sequence: Synthetic peptide
ILDTAGREEY

SEQ ID NO: 1651 - protein, 9 aa, Artificial Sequence
  Description of Artificial Sequence: Synthetic peptide
DTAGREEYS

SEQ ID NO: 1652 - protein, 8 aa, Artificial Sequence
  Description of Artificial Sequence: Synthetic peptide
ILDTAGRE

SEQ ID NO: 1653 - protein, 11 aa, Artificial Sequence
  Description of Artificial Sequence: Synthetic peptide
CLLDILDTAGR

SEQ ID NO: 1654 - protein, 12 aa, Artificial Sequence
  Description of Artificial Sequence: Synthetic peptide
DTAGREEYSAMR

SEQ ID NO: 1655 - protein, 10 aa, Artificial Sequence
  Description of Artificial Sequence: Synthetic peptide
LLDILDTAGR

SEQ ID NO: 1656 - protein, 8 aa, Artificial Sequence
  Description of Artificial Sequence: Synthetic peptide
DTAGREEY

SEQ ID NO: 1657 - protein, 10 aa, Artificial Sequence
  Description of Artificial Sequence: Synthetic peptide
ILDTAGREEY

SEQ ID NO: 1658 - protein, 8 aa, Artificial Sequence
  Description of Artificial Sequence: Synthetic peptide
DILDTAGR

SEQ ID NO: 1659 - protein, 9 aa, Artificial Sequence
  Description of Artificial Sequence: Synthetic peptide
ILDTAGREE

SEQ ID NO: 1660 - protein, 10 aa, Artificial Sequence
  Description of Artificial Sequence: Synthetic peptide
ILDTAGREEY

SEQ ID NO: 1661 - protein, 10 aa, Artificial Sequence
  Description of Artificial Sequence: Synthetic peptide
LLDILDTAGR

SEQ ID NO: 1662 - protein, 10 aa, Artificial Sequence
  Description of Artificial Sequence: Synthetic peptide
TAGREEYSAM

SEQ ID NO: 1663 - protein, 11 aa, Artificial Sequence
  Description of Artificial Sequence: Synthetic peptide
DILDTAGREEY

SEQ ID NO: 1664 - protein, 8 aa, Artificial Sequence
  Description of Artificial Sequence: Synthetic peptide
ILDTAGRE

SEQ ID NO: 1665 - protein, 9 aa, Artificial Sequence
  Description of Artificial Sequence: Synthetic peptide
ILDTAGREE

SEQ ID NO: 1666 - protein, 9 aa, Artificial Sequence
  Description of Artificial Sequence: Synthetic peptide
REEYSAMRD

SEQ ID NO: 1667 - protein, 9 aa, Artificial Sequence
  Description of Artificial Sequence: Synthetic peptide
AGREEYSAM

SEQ ID NO: 1668 - protein, 10 aa, Artificial Sequence
  Description of Artificial Sequence: Synthetic peptide
AGREEYSAMR

SEQ ID NO: 1669 - protein, 8 aa, Artificial Sequence
  Description of Artificial Sequence: Synthetic peptide
ILDTAGRE

SEQ ID NO: 1670 - protein, 9 aa, Artificial Sequence
  Description of Artificial Sequence: Synthetic peptide
LDILDTAGR

SEQ ID NO: 1671 - protein, 9 aa, Artificial Sequence
  Description of Artificial Sequence: Synthetic peptide
LDTAGREEY

SEQ ID NO: 1672 - protein, 9 aa, Artificial Sequence
  Description of Artificial Sequence: Synthetic peptide
LDTAGREEY

SEQ ID NO: 1673 - protein, 9 aa, Artificial Sequence
  Description of Artificial Sequence: Synthetic peptide
REEYSAMRD

SEQ ID NO: 1674 - protein, 11 aa, Artificial Sequence
  Description of Artificial Sequence: Synthetic peptide
REEYSAMRDQY

SEQ ID NO: 1675 - protein, 8 aa, Artificial Sequence
  Description of Artificial Sequence: Synthetic peptide
DTAGREEY

SEQ ID NO: 1676 - protein, 23 aa, Artificial Sequence
  Description of Artificial Sequence: Synthetic peptide
TCLLDILDTAGKEEYSAMRDQYM

SEQ ID NO: 1677 - protein, 10 aa, Artificial Sequence
  Description of Artificial Sequence: Synthetic peptide
ILDTAGKEEY

SEQ ID NO: 1678 - protein, 10 aa, Artificial Sequence
  Description of Artificial Sequence: Synthetic peptide
ILDTAGKEEY

SEQ ID NO: 1679 - protein, 11 aa, Artificial Sequence
  Description of Artificial Sequence: Synthetic peptide
DTAGKEEYSAM

SEQ ID NO: 1680 - protein, 11 aa, Artificial Sequence
  Description of Artificial Sequence: Synthetic peptide
CLLDILDTAGK

SEQ ID NO: 1681 - protein, 8 aa, Artificial Sequence
  Description of Artificial Sequence: Synthetic peptide
DTAGKEEY

SEQ ID NO: 1682 - protein, 8 aa, Artificial Sequence
  Description of Artificial Sequence: Synthetic peptide
DTAGKEEY

SEQ ID NO: 1683 - protein, 11 aa, Artificial Sequence
  Description of Artificial Sequence: Synthetic peptide
DTAGKEEYSAM

SEQ ID NO: 1684 - protein, 9 aa, Artificial Sequence
  Description of Artificial Sequence: Synthetic peptide
AGKEEYSAM

SEQ ID NO: 1685 - protein, 9 aa, Artificial Sequence
  Description of Artificial Sequence: Synthetic peptide
DILDTAGKE

SEQ ID NO: 1686 - protein, 9 aa, Artificial Sequence
  Description of Artificial Sequence: Synthetic peptide
KEEYSAMRD

SEQ ID NO: 1687 - protein, 8 aa, Artificial Sequence
  Description of Artificial Sequence: Synthetic peptide
DTAGKEEY

SEQ ID NO: 1688 - protein, 8 aa, Artificial Sequence
  Description of Artificial Sequence: Synthetic peptide
GKEEYSAM

SEQ ID NO: 1689 - protein, 9 aa, Artificial Sequence
  Description of Artificial Sequence: Synthetic peptide
ILDTAGKEE

SEQ ID NO: 1690 - protein, 10 aa, Artificial Sequence
  Description of Artificial Sequence: Synthetic peptide
ILDTAGKEEY

SEQ ID NO: 1691 - protein, 9 aa, Artificial Sequence
  Description of Artificial Sequence: Synthetic peptide
DTAGKEEYS

SEQ ID NO: 1692 - protein, 9 aa, Artificial Sequence
  Description of Artificial Sequence: Synthetic peptide
LDTAGKEEY

SEQ ID NO: 1693 - protein, 9 aa, Artificial Sequence
  Description of Artificial Sequence: Synthetic peptide
TAGKEEYSA

SEQ ID NO: 1694 - protein, 8 aa, Artificial Sequence
  Description of Artificial Sequence: Synthetic peptide
DILDTAGK

SEQ ID NO: 1695 - protein, 8 aa, Artificial Sequence
  Description of Artificial Sequence: Synthetic peptide
DTAGKEEY

SEQ ID NO: 1696 - protein, 9 aa, Artificial Sequence
  Description of Artificial Sequence: Synthetic peptide
KEEYSAMRD

SEQ ID NO: 1697 - protein, 9 aa, Artificial Sequence
  Description of Artificial Sequence: Synthetic peptide
LDTAGKEEY

SEQ ID NO: 1698 - protein, 12 aa, Artificial Sequence
  Description of Artificial Sequence: Synthetic peptide
DTAGKEEYSAMR

SEQ ID NO: 1699 - protein, 9 aa, Artificial Sequence
  Description of Artificial Sequence: Synthetic peptide
ILDTAGKEE

SEQ ID NO: 1700 - protein, 10 aa, Artificial Sequence
  Description of Artificial Sequence: Synthetic peptide
ILDTAGKEEY

SEQ ID NO: 1701 - protein, 10 aa, Artificial Sequence
  Description of Artificial Sequence: Synthetic peptide
LLDILDTAGK

SEQ ID NO: 1702 - protein, 9 aa, Artificial Sequence
  Description of Artificial Sequence: Synthetic peptide
AGKEEYSAM

SEQ ID NO: 1703 - protein, 8 aa, Artificial Sequence
  Description of Artificial Sequence: Synthetic peptide
DTAGKEEY

SEQ ID NO: 1704 - protein, 9 aa, Artificial Sequence
  Description of Artificial Sequence: Synthetic peptide
DTAGKEEYS

SEQ ID NO: 1705 - protein, 8 aa, Artificial Sequence
  Description of Artificial Sequence: Synthetic peptide
ILDTAGKE

SEQ ID NO: 1706 - protein, 9 aa, Artificial Sequence
  Description of Artificial Sequence: Synthetic peptide
LDTAGKEEY

SEQ ID NO: 1707 - protein, 10 aa, Artificial Sequence
  Description of Artificial Sequence: Synthetic peptide
AGKEEYSAMR

SEQ ID NO: 1708 - protein, 8 aa, Artificial Sequence
  Description of Artificial Sequence: Synthetic peptide
DILDTAGK

SEQ ID NO: 1709 - protein, 8 aa, Artificial Sequence
  Description of Artificial Sequence: Synthetic peptide
ILDTAGKE

SEQ ID NO: 1710 - protein, 9 aa, Artificial Sequence
  Description of Artificial Sequence: Synthetic peptide
ILDTAGKEE

SEQ ID NO: 1711 - protein, 9 aa, Artificial Sequence
  Description of Artificial Sequence: Synthetic peptide
ILDTAGKEE

SEQ ID NO: 1712 - protein, 10 aa, Artificial Sequence
  Description of Artificial Sequence: Synthetic peptide
TAGKEEYSAM

SEQ ID NO: 1713 - protein, 9 aa, Artificial Sequence
  Description of Artificial Sequence: Synthetic peptide
AGKEEYSAM

SEQ ID NO: 1714 - protein, 10 aa, Artificial Sequence
  Description of Artificial Sequence: Synthetic peptide
ILDTAGKEEY

SEQ ID NO: 1715 - protein, 9 aa, Artificial Sequence
  Description of Artificial Sequence: Synthetic peptide
LDTAGKEEY

SEQ ID NO: 1716 - protein, 8 aa, Artificial Sequence
  Description of Artificial Sequence: Synthetic peptide
DTAGKEEY

SEQ ID NO: 1717 - protein, 10 aa, Artificial Sequence
  Description of Artificial Sequence: Synthetic peptide
ILDTAGKEEY

SEQ ID NO: 1718 - protein, 9 aa, Artificial Sequence
  Description of Artificial Sequence: Synthetic peptide
AGKEEYSAM

SEQ ID NO: 1719 - protein, 9 aa, Artificial Sequence
  Description of Artificial Sequence: Synthetic peptide
AGKEEYSAM

SEQ ID NO: 1720 - protein, 8 aa, Artificial Sequence
  Description of Artificial Sequence: Synthetic peptide
DTAGKEEY

SEQ ID NO: 1721 - protein, 9 aa, Artificial Sequence
  Description of Artificial Sequence: Synthetic peptide
LDTAGKEEY

SEQ ID NO: 1722 - protein, 23 aa, Artificial Sequence
  Description of Artificial Sequence: Synthetic peptide
TCLLDILDTAGLEEYSAMRDQYM

SEQ ID NO: 1723 - protein, 10 aa, Artificial Sequence
  Description of Artificial Sequence: Synthetic peptide
ILDTAGLEEY

SEQ ID NO: 1724 - protein, 10 aa, Artificial Sequence
  Description of Artificial Sequence: Synthetic peptide
ILDTAGLEEY

SEQ ID NO: 1725 - protein, 10 aa, Artificial Sequence
  Description of Artificial Sequence: Synthetic peptide
LLDILDTAGL

SEQ ID NO: 1726 - protein, 12 aa, Artificial Sequence
  Description of Artificial Sequence: Synthetic peptide
GLEEYSAMRDQY

SEQ ID NO: 1727 - protein, 8 aa, Artificial Sequence
  Description of Artificial Sequence: Synthetic peptide
DTAGLEEY

SEQ ID NO: 1728 - protein, 8 aa, Artificial Sequence
  Description of Artificial Sequence: Synthetic peptide
DTAGLEEY

SEQ ID NO: 1729 - protein, 11 aa, Artificial Sequence
  Description of Artificial Sequence: Synthetic peptide
DTAGLEEYSAM

SEQ ID NO: 1730 - protein, 8 aa, Artificial Sequence
  Description of Artificial Sequence: Synthetic peptide
DTAGLEEY

SEQ ID NO: 1731 - protein, 9 aa, Artificial Sequence
  Description of Artificial Sequence: Synthetic peptide
ILDTAGLEE

SEQ ID NO: 1732 - protein, 9 aa, Artificial Sequence
  Description of Artificial Sequence: Synthetic peptide
ILDTAGLEE

SEQ ID NO: 1733 - protein, 11 aa, Artificial Sequence
  Description of Artificial Sequence: Synthetic peptide
CLLDILDTAGL

SEQ ID NO: 1734 - protein, 9 aa, Artificial Sequence
  Description of Artificial Sequence: Synthetic peptide
ILDTAGLEE

SEQ ID NO: 1735 - protein, 10 aa, Artificial Sequence
  Description of Artificial Sequence: Synthetic peptide
LLDILDTAGL

SEQ ID NO: 1736 - protein, 8 aa, Artificial Sequence
  Description of Artificial Sequence: Synthetic peptide
DILDTAGL

SEQ ID NO: 1737 - protein, 11 aa, Artificial Sequence
  Description of Artificial Sequence: Synthetic peptide
DILDTAGLEEY

SEQ ID NO: 1738 - protein, 9 aa, Artificial Sequence
  Description of Artificial Sequence: Synthetic peptide
DTAGLEEYS

SEQ ID NO: 1739 - protein, 11 aa, Artificial Sequence
  Description of Artificial Sequence: Synthetic peptide
DTAGLEEYSAM

SEQ ID NO: 1740 - protein, 9 aa, Artificial Sequence
  Description of Artificial Sequence: Synthetic peptide
GLEEYSAMR

SEQ ID NO: 1741 - protein, 8 aa, Artificial Sequence
  Description of Artificial Sequence: Synthetic peptide
ILDTAGLE

SEQ ID NO: 1742 - protein, 11 aa, Artificial Sequence
  Description of Artificial Sequence: Synthetic peptide
DILDTAGLEEY

SEQ ID NO: 1743 - protein, 8 aa, Artificial Sequence
  Description of Artificial Sequence: Synthetic peptide
DTAGLEEY

SEQ ID NO: 1744 - protein, 10 aa, Artificial Sequence
  Description of Artificial Sequence: Synthetic peptide
ILDTAGLEEY

SEQ ID NO: 1745 - protein, 8 aa, Artificial Sequence
  Description of Artificial Sequence: Synthetic peptide
DILDTAGL

SEQ ID NO: 1746 - protein, 8 aa, Artificial Sequence
  Description of Artificial Sequence: Synthetic peptide
DTAGLEEY

SEQ ID NO: 1747 - protein, 9 aa, Artificial Sequence
  Description of Artificial Sequence: Synthetic peptide
ILDTAGLEE

SEQ ID NO: 1748 - protein, 9 aa, Artificial Sequence
  Description of Artificial Sequence: Synthetic peptide
LDTAGLEEY

SEQ ID NO: 1749 - protein, 11 aa, Artificial Sequence
  Description of Artificial Sequence: Synthetic peptide
CLLDILDTAGL

SEQ ID NO: 1750 - protein, 8 aa, Artificial Sequence
  Description of Artificial Sequence: Synthetic peptide
DTAGLEEY

SEQ ID NO: 1751 - protein, 9 aa, Artificial Sequence
  Description of Artificial Sequence: Synthetic peptide
ILDTAGLEE

SEQ ID NO: 1752 - protein, 10 aa, Artificial Sequence
  Description of Artificial Sequence: Synthetic peptide
ILDTAGLEEY

SEQ ID NO: 1753 - protein, 10 aa, Artificial Sequence
  Description of Artificial Sequence: Synthetic peptide
ILDTAGLEEY

SEQ ID NO: 1754 - protein, 10 aa, Artificial Sequence
  Description of Artificial Sequence: Synthetic peptide
LLDILDTAGL

SEQ ID NO: 1755 - protein, 8 aa, Artificial Sequence
  Description of Artificial Sequence: Synthetic peptide
DILDTAGL

SEQ ID NO: 1756 - protein, 9 aa, Artificial Sequence
  Description of Artificial Sequence: Synthetic peptide
LDTAGLEEY

SEQ ID NO: 1757 - protein, 8 aa, Artificial Sequence
  Description of Artificial Sequence: Synthetic peptide
DTAGLEEY

SEQ ID NO: 1758 - protein, 8 aa, Artificial Sequence
  Description of Artificial Sequence: Synthetic peptide
DTAGLEEY

SEQ ID NO: 1759 - protein, 10 aa, Artificial Sequence
  Description of Artificial Sequence: Synthetic peptide
ILDTAGLEEY

SEQ ID NO: 1760 - protein, 10 aa, Artificial Sequence
  Description of Artificial Sequence: Synthetic peptide
LLDILDTAGL

SEQ ID NO: 1761 - protein, 10 aa, Artificial Sequence
  Description of Artificial Sequence: Synthetic peptide
LLDILDTAGL

SEQ ID NO: 1762 - protein, 12 aa, Artificial Sequence
  Description of Artificial Sequence: Synthetic peptide
DTAGLEEYSAMR

SEQ ID NO: 1763 - protein, 8 aa, Artificial Sequence
  Description of Artificial Sequence: Synthetic peptide
ILDTAGLE

SEQ ID NO: 1764 - protein, 10 aa, Artificial Sequence
  Description of Artificial Sequence: Synthetic peptide
LLDILDTAGL

SEQ ID NO: 1765 - protein, 9 aa, Artificial Sequence
  Description of Artificial Sequence: Synthetic peptide
AGLEEYSAM

SEQ ID NO: 1766 - protein, 10 aa, Artificial Sequence
  Description of Artificial Sequence: Synthetic peptide
DTAGLEEYSA

SEQ ID NO: 1767 - protein, 12 aa, Artificial Sequence
  Description of Artificial Sequence: Synthetic peptide
GLEEYSAMRDQY

SEQ ID NO: 1768 - protein, 8 aa, Artificial Sequence
  Description of Artificial Sequence: Synthetic peptide
ILDTAGLE

SEQ ID NO: 1769 - protein, 10 aa, Artificial Sequence
  Description of Artificial Sequence: Synthetic peptide
ILDTAGLEEY

SEQ ID NO: 1770 - protein, 9 aa, Artificial Sequence
  Description of Artificial Sequence: Synthetic peptide
LDILDTAGL

SEQ ID NO: 1771 - protein, 9 aa, Artificial Sequence
  Description of Artificial Sequence: Synthetic peptide
AGLEEYSAM

SEQ ID NO: 1772 - protein, 9 aa, Artificial Sequence
  Description of Artificial Sequence: Synthetic peptide
AGLEEYSAM

SEQ ID NO: 1773 - protein, 10 aa, Artificial Sequence
  Description of Artificial Sequence: Synthetic peptide
AGLEEYSAMR

SEQ ID NO: 1774 - protein, 9 aa, Artificial Sequence
  Description of Artificial Sequence: Synthetic peptide
ILDTAGLEE

SEQ ID NO: 1775 - protein, 9 aa, Artificial Sequence
  Description of Artificial Sequence: Synthetic peptide
LDTAGLEEY

SEQ ID NO: 1776 - protein, 9 aa, Artificial Sequence
  Description of Artificial Sequence: Synthetic peptide
AGLEEYSAM

SEQ ID NO: 1777 - protein, 9 aa, Artificial Sequence
  Description of Artificial Sequence: Synthetic peptide
GLEEYSAMR

SEQ ID NO: 1778 - protein, 9 aa, Artificial Sequence
  Description of Artificial Sequence: Synthetic peptide
LEEYSAMRD

SEQ ID NO: 1779 - protein, 11 aa, Artificial Sequence
  Description of Artificial Sequence: Synthetic peptide
LLDILDTAGLE

SEQ ID NO: 1780 - protein, 9 aa, Artificial Sequence
  Description of Artificial Sequence: Synthetic peptide
AGLEEYSAM

SEQ ID NO: 1781 - protein, 9 aa, Artificial Sequence
  Description of Artificial Sequence: Synthetic peptide
LDILDTAGL

SEQ ID NO: 1782 - protein, 9 aa, Artificial Sequence
  Description of Artificial Sequence: Synthetic peptide
LDTAGLEEY

SEQ ID NO: 1783 - protein, 9 aa, Artificial Sequence
  Description of Artificial Sequence: Synthetic peptide
DILDTAGLE

SEQ ID NO: 1784 - protein, 8 aa, Artificial Sequence
  Description of Artificial Sequence: Synthetic peptide
DTAGLEEY

SEQ ID NO: 1785 - protein, 10 aa, Artificial Sequence
  Description of Artificial Sequence: Synthetic peptide
ILDTAGLEEY

SEQ ID NO: 1786 - protein, 9 aa, Artificial Sequence
  Description of Artificial Sequence: Synthetic peptide
LDTAGLEEY

SEQ ID NO: 1787 - protein, 9 aa, Artificial Sequence
  Description of Artificial Sequence: Synthetic peptide
LDTAGLEEY

SEQ ID NO: 1788 - protein, 8 aa, Artificial Sequence
  Description of Artificial Sequence: Synthetic peptide
DTAGLEEY

SEQ ID NO: 1789 - protein, 8 aa, Artificial Sequence
  Description of Artificial Sequence: Synthetic peptide
DTAGLEEY

SEQ ID NO: 1790 - protein, 8 aa, Artificial Sequence
  Description of Artificial Sequence: Synthetic peptide
ILDTAGLE

SEQ ID NO: 1791 - protein, 9 aa, Artificial Sequence
  Description of Artificial Sequence: Synthetic peptide
LDTAGLEEY

SEQ ID NO: 1792 - protein, 9 aa, Artificial Sequence
  Description of Artificial Sequence: Synthetic peptide
LEEYSAMRD

SEQ ID NO: 1793 - protein, 9 aa, Artificial Sequence
  Description of Artificial Sequence: Synthetic peptide
TAGLEEYSA

SEQ ID NO: 1794 - protein, 11 aa, Artificial Sequence
  Description of Artificial Sequence: Synthetic peptide
DILDTAGLEEY

SEQ ID NO: 1795 - protein, 8 aa, Artificial Sequence
  Description of Artificial Sequence: Synthetic peptide
GLEEYSAM

SEQ ID NO: 1796 - protein, 23 aa, Artificial Sequence
  Description of Artificial Sequence: Synthetic peptide
MTEYKLVVVGAAGVGKSALTIQL

SEQ ID NO: 1797 - protein, 9 aa, Artificial Sequence
  Description of Artificial Sequence: Synthetic peptide
AAGVGKSAL

SEQ ID NO: 1798 - protein, 10 aa, Artificial Sequence
  Description of Artificial Sequence: Synthetic peptide
VVVGAAGVGK

SEQ ID NO: 1799 - protein, 9 aa, Artificial Sequence
  Description of Artificial Sequence: Synthetic peptide
VVGAAGVGK

SEQ ID NO: 1800 - protein, 11 aa, Artificial Sequence
  Description of Artificial Sequence: Synthetic peptide
TEYKLVVVGAA

SEQ ID NO: 1801 - protein, 9 aa, Artificial Sequence
  Description of Artificial Sequence: Synthetic peptide
VVGAAGVGK

SEQ ID NO: 1802 - protein, 10 aa, Artificial Sequence
  Description of Artificial Sequence: Synthetic peptide
VVVGAAGVGK

SEQ ID NO: 1803 - protein, 9 aa, Artificial Sequence
  Description of Artificial Sequence: Synthetic peptide
AAGVGKSAL

SEQ ID NO: 1804 - protein, 9 aa, Artificial Sequence
  Description of Artificial Sequence: Synthetic peptide
AAGVGKSAL

SEQ ID NO: 1805 - protein, 9 aa, Artificial Sequence
  Description of Artificial Sequence: Synthetic peptide
AAGVGKSAL

SEQ ID NO: 1806 - protein, 9 aa, Artificial Sequence
  Description of Artificial Sequence: Synthetic peptide
AAGVGKSAL

SEQ ID NO: 1807 - protein, 10 aa, Artificial Sequence
  Description of Artificial Sequence: Synthetic peptide
GAAGVGKSAL

SEQ ID NO: 1808 - protein, 9 aa, Artificial Sequence
  Description of Artificial Sequence: Synthetic peptide
LVVVGAAGV

SEQ ID NO: 1809 - protein, 9 aa, Artificial Sequence
  Description of Artificial Sequence: Synthetic peptide
AAGVGKSAL

SEQ ID NO: 1810 - protein, 10 aa, Artificial Sequence
  Description of Artificial Sequence: Synthetic peptide
VVVGAAGVGK

SEQ ID NO: 1811 - protein, 9 aa, Artificial Sequence
  Description of Artificial Sequence: Synthetic peptide
VVGAAGVGK

SEQ ID NO: 1812 - protein, 11 aa, Artificial Sequence
  Description of Artificial Sequence: Synthetic peptide
TEYKLVVVGAA

SEQ ID NO: 1813 - protein, 9 aa, Artificial Sequence
  Description of Artificial Sequence: Synthetic peptide
VVGAAGVGK

SEQ ID NO: 1814 - protein, 10 aa, Artificial Sequence
  Description of Artificial Sequence: Synthetic peptide
VVVGAAGVGK

SEQ ID NO: 1815 - protein, 9 aa, Artificial Sequence
  Description of Artificial Sequence: Synthetic peptide
AAGVGKSAL

SEQ ID NO: 1816 - protein, 9 aa, Artificial Sequence
  Description of Artificial Sequence: Synthetic peptide
AAGVGKSAL

SEQ ID NO: 1817 - protein, 9 aa, Artificial Sequence
  Description of Artificial Sequence: Synthetic peptide
AAGVGKSAL

SEQ ID NO: 1818 - protein, 9 aa, Artificial Sequence
  Description of Artificial Sequence: Synthetic peptide
AAGVGKSAL

SEQ ID NO: 1819 - protein, 9 aa, Artificial Sequence
  Description of Artificial Sequence: Synthetic peptide
AAGVGKSAL

SEQ ID NO: 1820 - protein, 9 aa, Artificial Sequence
  Description of Artificial Sequence: Synthetic peptide
AAGVGKSAL

SEQ ID NO: 1821 - protein, 10 aa, Artificial Sequence
  Description of Artificial Sequence: Synthetic peptide
GAAGVGKSAL

SEQ ID NO: 1822 - protein, 9 aa, Artificial Sequence
  Description of Artificial Sequence: Synthetic peptide
LVVVGAAGV

SEQ ID NO: 1823 - protein, 9 aa, Artificial Sequence
  Description of Artificial Sequence: Synthetic peptide
AAGVGKSAL

SEQ ID NO: 1824 - protein, 9 aa, Artificial Sequence
  Description of Artificial Sequence: Synthetic peptide
VVGAAGVGK

SEQ ID NO: 1825 - protein, 10 aa, Artificial Sequence
  Description of Artificial Sequence: Synthetic peptide
GAAGVGKSAL

SEQ ID NO: 1826 - protein, 10 aa, Artificial Sequence
  Description of Artificial Sequence: Synthetic peptide
VVVGAAGVGK

SEQ ID NO: 1827 - protein, 9 aa, Artificial Sequence
  Description of Artificial Sequence: Synthetic peptide
AAGVGKSAL

SEQ ID NO: 1828 - protein, 9 aa, Artificial Sequence
  Description of Artificial Sequence: Synthetic peptide
AAGVGKSAL

SEQ ID NO: 1829 - protein, 9 aa, Artificial Sequence
  Description of Artificial Sequence: Synthetic peptide
GAAGVGKSA

SEQ ID NO: 1830 - protein, 9 aa, Artificial Sequence
  Description of Artificial Sequence: Synthetic peptide
VVGAAGVGK

SEQ ID NO: 1831 - protein, 9 aa, Artificial Sequence
  Description of Artificial Sequence: Synthetic peptide
GAAGVGKSA

SEQ ID NO: 1832 - protein, 10 aa, Artificial Sequence
  Description of Artificial Sequence: Synthetic peptide
KLVVVGAAGV

SEQ ID NO: 1833 - protein, 8 aa, Artificial Sequence
  Description of Artificial Sequence: Synthetic peptide
AGVGKSAL

SEQ ID NO: 1834 - protein, 10 aa, Artificial Sequence
  Description of Artificial Sequence: Synthetic peptide
GAAGVGKSAL

SEQ ID NO: 1835 - protein, 9 aa, Artificial Sequence
  Description of Artificial Sequence: Synthetic peptide
AAGVGKSAL

SEQ ID NO: 1836 - protein, 10 aa, Artificial Sequence
  Description of Artificial Sequence: Synthetic peptide
GAAGVGKSAL

SEQ ID NO: 1837 - protein, 8 aa, Artificial Sequence
  Description of Artificial Sequence: Synthetic peptide
VVVGAAGV

SEQ ID NO: 1838 - protein, 9 aa, Artificial Sequence
  Description of Artificial Sequence: Synthetic peptide
YKLVVVGAA

SEQ ID NO: 1839 - protein, 9 aa, Artificial Sequence
  Description of Artificial Sequence: Synthetic peptide
AAGVGKSAL

SEQ ID NO: 1840 - protein, 8 aa, Artificial Sequence
  Description of Artificial Sequence: Synthetic peptide
AGVGKSAL

SEQ ID NO: 1841 - protein, 8 aa, Artificial Sequence
  Description of Artificial Sequence: Synthetic peptide
AGVGKSAL

SEQ ID NO: 1842 - protein, 10 aa, Artificial Sequence
  Description of Artificial Sequence: Synthetic peptide
VVVGAAGVGK

SEQ ID NO: 1843 - protein, 8 aa, Artificial Sequence
  Description of Artificial Sequence: Synthetic peptide
AAGVGKSA

SEQ ID NO: 1844 - protein, 10 aa, Artificial Sequence
  Description of Artificial Sequence: Synthetic peptide
KLVVVGAAGV

SEQ ID NO: 1845 - protein, 9 aa, Artificial Sequence
  Description of Artificial Sequence: Synthetic peptide
YKLVVVGAA

SEQ ID NO: 1846 - protein, 9 aa, Artificial Sequence
  Description of Artificial Sequence: Synthetic peptide
AAGVGKSAL

SEQ ID NO: 1847 - protein, 10 aa, Artificial Sequence
  Description of Artificial Sequence: Synthetic peptide
GAAGVGKSAL

SEQ ID NO: 1848 - protein, 9 aa, Artificial Sequence
  Description of Artificial Sequence: Synthetic peptide
VVGAAGVGK

SEQ ID NO: 1849 - protein, 8 aa, Artificial Sequence
  Description of Artificial Sequence: Synthetic peptide
AGVGKSAL

SEQ ID NO: 1850 - protein, 10 aa, Artificial Sequence
  Description of Artificial Sequence: Synthetic peptide
GAAGVGKSAL

SEQ ID NO: 1851 - protein, 10 aa, Artificial Sequence
  Description of Artificial Sequence: Synthetic peptide
GAAGVGKSAL

SEQ ID NO: 1852 - protein, 10 aa, Artificial Sequence
  Description of Artificial Sequence: Synthetic peptide
GAAGVGKSAL

SEQ ID NO: 1853 - protein, 9 aa, Artificial Sequence
  Description of Artificial Sequence: Synthetic peptide
AAGVGKSAL

SEQ ID NO: 1854 - protein, 9 aa, Artificial Sequence
  Description of Artificial Sequence: Synthetic peptide
AAGVGKSAL

SEQ ID NO: 1855 - protein, 9 aa, Artificial Sequence
  Description of Artificial Sequence: Synthetic peptide
AAGVGKSAL

SEQ ID NO: 1856 - protein, 9 aa, Artificial Sequence
  Description of Artificial Sequence: Synthetic peptide
AAGVGKSAL

SEQ ID NO: 1857 - protein, 9 aa, Artificial Sequence
  Description of Artificial Sequence: Synthetic peptide
GAAGVGKSA

SEQ ID NO: 1858 - protein, 8 aa, Artificial Sequence
  Description of Artificial Sequence: Synthetic peptide
AGVGKSAL

SEQ ID NO: 1859 - protein, 9 aa, Artificial Sequence
  Description of Artificial Sequence: Synthetic peptide
GAAGVGKSA

SEQ ID NO: 1860 - protein, 9 aa, Artificial Sequence
  Description of Artificial Sequence: Synthetic peptide
LVVVGAAGV

SEQ ID NO: 1861 - protein, 11 aa, Artificial Sequence
  Description of Artificial Sequence: Synthetic peptide
TEYKLVVVGAA

SEQ ID NO: 1862 - protein, 8 aa, Artificial Sequence
  Description of Artificial Sequence: Synthetic peptide
AGVGKSAL

SEQ ID NO: 1863 - protein, 9 aa, Artificial Sequence
  Description of Artificial Sequence: Synthetic peptide
GAAGVGKSA

SEQ ID NO: 1864 - protein, 10 aa, Artificial Sequence
  Description of Artificial Sequence: Synthetic peptide
GAAGVGKSAL

SEQ ID NO: 1865 - protein, 10 aa, Artificial Sequence
  Description of Artificial Sequence: Synthetic peptide
VGAAGVGKSA

SEQ ID NO: 1866 - protein, 8 aa, Artificial Sequence
  Description of Artificial Sequence: Synthetic peptide
AGVGKSAL

SEQ ID NO: 1867 - protein, 10 aa, Artificial Sequence
  Description of Artificial Sequence: Synthetic peptide
AGVGKSALTI

SEQ ID NO: 1868 - protein, 8 aa, Artificial Sequence
  Description of Artificial Sequence: Synthetic peptide
VVVGAAGV

SEQ ID NO: 1869 - protein, 23 aa, Artificial Sequence
  Description of Artificial Sequence: Synthetic peptide
MTEYKLVVVGACGVGKSALTIQL

SEQ ID NO: 1870 - protein, 10 aa, Artificial Sequence
  Description of Artificial Sequence: Synthetic peptide
VVVGACGVGK

SEQ ID NO: 1871 - protein, 9 aa, Artificial Sequence
  Description of Artificial Sequence: Synthetic peptide
VVGACGVGK

SEQ ID NO: 1872 - protein, 9 aa, Artificial Sequence
  Description of Artificial Sequence: Synthetic peptide
VVGACGVGK

SEQ ID NO: 1873 - protein, 10 aa, Artificial Sequence
  Description of Artificial Sequence: Synthetic peptide
VVVGACGVGK

SEQ ID NO: 1874 - protein, 9 aa, Artificial Sequence
  Description of Artificial Sequence: Synthetic peptide
VVGACGVGK

SEQ ID NO: 1875 - protein, 10 aa, Artificial Sequence
  Description of Artificial Sequence: Synthetic peptide
VVVGACGVGK

SEQ ID NO: 1876 - protein, 9 aa, Artificial Sequence
  Description of Artificial Sequence: Synthetic peptide
VVGACGVGK

SEQ ID NO: 1877 - protein, 9 aa, Artificial Sequence
  Description of Artificial Sequence: Synthetic peptide
ACGVGKSAL

SEQ ID NO: 1878 - protein, 9 aa, Artificial Sequence
  Description of Artificial Sequence: Synthetic peptide
ACGVGKSAL

SEQ ID NO: 1879 - protein, 9 aa, Artificial Sequence
  Description of Artificial Sequence: Synthetic peptide
ACGVGKSAL

SEQ ID NO: 1880 - protein, 9 aa, Artificial Sequence
  Description of Artificial Sequence: Synthetic peptide
ACGVGKSAL

SEQ ID NO: 1881 - protein, 10 aa, Artificial Sequence
  Description of Artificial Sequence: Synthetic peptide
VVVGACGVGK

SEQ ID NO: 1882 - protein, 9 aa, Artificial Sequence
  Description of Artificial Sequence: Synthetic peptide
ACGVGKSAL

SEQ ID NO: 1883 - protein, 8 aa, Artificial Sequence
  Description of Artificial Sequence: Synthetic peptide
CGVGKSAL

SEQ ID NO: 1884 - protein, 10 aa, Artificial Sequence
  Description of Artificial Sequence: Synthetic peptide
KLVVVGACGV

SEQ ID NO: 1885 - protein, 9 aa, Artificial Sequence
  Description of Artificial Sequence: Synthetic peptide
ACGVGKSAL

SEQ ID NO: 1886 - protein, 10 aa, Artificial Sequence
  Description of Artificial Sequence: Synthetic peptide
GACGVGKSAL

SEQ ID NO: 1887 - protein, 10 aa, Artificial Sequence
  Description of Artificial Sequence: Synthetic peptide
GACGVGKSAL

SEQ ID NO: 1888 - protein, 9 aa, Artificial Sequence
  Description of Artificial Sequence: Synthetic peptide
ACGVGKSAL

SEQ ID NO: 1889 - protein, 9 aa, Artificial Sequence
  Description of Artificial Sequence: Synthetic peptide
ACGVGKSAL

SEQ ID NO: 1890 - protein, 9 aa, Artificial Sequence
  Description of Artificial Sequence: Synthetic peptide
YKLVVVGAC

SEQ ID NO: 1891 - protein, 9 aa, Artificial Sequence
  Description of Artificial Sequence: Synthetic peptide
YKLVVVGAC

SEQ ID NO: 1892 - protein, 9 aa, Artificial Sequence
  Description of Artificial Sequence: Synthetic peptide
GACGVGKSA

SEQ ID NO: 1893 - protein, 10 aa, Artificial Sequence
  Description of Artificial Sequence: Synthetic peptide
GACGVGKSAL

SEQ ID NO: 1894 - protein, 10 aa, Artificial Sequence
  Description of Artificial Sequence: Synthetic peptide
GACGVGKSAL

SEQ ID NO: 1895 - protein, 9 aa, Artificial Sequence
  Description of Artificial Sequence: Synthetic peptide
LVVVGACGV

SEQ ID NO: 1896 - protein, 8 aa, Artificial Sequence
  Description of Artificial Sequence: Synthetic peptide
CGVGKSAL

SEQ ID NO: 1897 - protein, 10 aa, Artificial Sequence
  Description of Artificial Sequence: Synthetic peptide
GACGVGKSAL

SEQ ID NO: 1898 - protein, 9 aa, Artificial Sequence
  Description of Artificial Sequence: Synthetic peptide
VVGACGVGK

SEQ ID NO: 1899 - protein, 23 aa, Artificial Sequence
  Description of Artificial Sequence: Synthetic peptide
MTEYKLVVVGADGVGKSALTIQL

SEQ ID NO: 1900 - protein, 10 aa, Artificial Sequence
  Description of Artificial Sequence: Synthetic peptide
GADGVGKSAL

SEQ ID NO: 1901 - protein, 10 aa, Artificial Sequence
  Description of Artificial Sequence: Synthetic peptide
GADGVGKSAL

SEQ ID NO: 1902 - protein, 10 aa, Artificial Sequence
  Description of Artificial Sequence: Synthetic peptide
VVVGADGVGK

SEQ ID NO: 1903 - protein, 8 aa, Artificial Sequence
  Description of Artificial Sequence: Synthetic peptide
DGVGKSAL

SEQ ID NO: 1904 - protein, 9 aa, Artificial Sequence
  Description of Artificial Sequence: Synthetic peptide
VVGADGVGK

SEQ ID NO: 1905 - protein, 9 aa, Artificial Sequence
  Description of Artificial Sequence: Synthetic peptide
VVGADGVGK

SEQ ID NO: 1906 - protein, 8 aa, Artificial Sequence
  Description of Artificial Sequence: Synthetic peptide
DGVGKSAL

SEQ ID NO: 1907 - protein, 10 aa, Artificial Sequence
  Description of Artificial Sequence: Synthetic peptide
VVVGADGVGK

SEQ ID NO: 1908 - protein, 10 aa, Artificial Sequence
  Description of Artificial Sequence: Synthetic peptide
GADGVGKSAL

SEQ ID NO: 1909 - protein, 9 aa, Artificial Sequence
  Description of Artificial Sequence: Synthetic peptide
VVGADGVGK

SEQ ID NO: 1910 - protein, 9 aa, Artificial Sequence
  Description of Artificial Sequence: Synthetic peptide
ADGVGKSAL

SEQ ID NO: 1911 - protein, 10 aa, Artificial Sequence
  Description of Artificial Sequence: Synthetic peptide
GADGVGKSAL

SEQ ID NO: 1912 - protein, 9 aa, Artificial Sequence
  Description of Artificial Sequence: Synthetic peptide
VVGADGVGK

SEQ ID NO: 1913 - protein, 9 aa, Artificial Sequence
  Description of Artificial Sequence: Synthetic peptide
GADGVGKSA

SEQ ID NO: 1914 - protein, 10 aa, Artificial Sequence
  Description of Artificial Sequence: Synthetic peptide
GADGVGKSAL

SEQ ID NO: 1915 - protein, 8 aa, Artificial Sequence
  Description of Artificial Sequence: Synthetic peptide
GADGVGKS

SEQ ID NO: 1916 - protein, 9 aa, Artificial Sequence
  Description of Artificial Sequence: Synthetic peptide
GADGVGKSA

SEQ ID NO: 1917 - protein, 9 aa, Artificial Sequence
  Description of Artificial Sequence: Synthetic peptide
ADGVGKSAL

SEQ ID NO: 1918 - protein, 10 aa, Artificial Sequence
  Description of Artificial Sequence: Synthetic peptide
VVVGADGVGK

SEQ ID NO: 1919 - protein, 9 aa, Artificial Sequence
  Description of Artificial Sequence: Synthetic peptide
ADGVGKSAL

SEQ ID NO: 1920 - protein, 9 aa, Artificial Sequence
  Description of Artificial Sequence: Synthetic peptide
ADGVGKSAL

SEQ ID NO: 1921 - protein, 10 aa, Artificial Sequence
  Description of Artificial Sequence: Synthetic peptide
GADGVGKSAL

SEQ ID NO: 1922 - protein, 9 aa, Artificial Sequence
  Description of Artificial Sequence: Synthetic peptide
ADGVGKSAL

SEQ ID NO: 1923 - protein, 10 aa, Artificial Sequence
  Description of Artificial Sequence: Synthetic peptide
GADGVGKSAL

SEQ ID NO: 1924 - protein, 10 aa, Artificial Sequence
  Description of Artificial Sequence: Synthetic peptide
VVVGADGVGK

SEQ ID NO: 1925 - protein, 9 aa, Artificial Sequence
  Description of Artificial Sequence: Synthetic peptide
GADGVGKSA

SEQ ID NO: 1926 - protein, 9 aa, Artificial Sequence
  Description of Artificial Sequence: Synthetic peptide
GADGVGKSA

SEQ ID NO: 1927 - protein, 10 aa, Artificial Sequence
  Description of Artificial Sequence: Synthetic peptide
GADGVGKSAL

SEQ ID NO: 1928 - protein, 10 aa, Artificial Sequence
  Description of Artificial Sequence: Synthetic peptide
KLVVVGADGV

SEQ ID NO: 1929 - protein, 9 aa, Artificial Sequence
  Description of Artificial Sequence: Synthetic peptide
LVVVGADGV

SEQ ID NO: 1930 - protein, 10 aa, Artificial Sequence
  Description of Artificial Sequence: Synthetic peptide
VGADGVGKSA

SEQ ID NO: 1931 - protein, 9 aa, Artificial Sequence
  Description of Artificial Sequence: Synthetic peptide
VVGADGVGK

SEQ ID NO: 1932 - protein, 9 aa, Artificial Sequence
  Description of Artificial Sequence: Synthetic peptide
GADGVGKSA

SEQ ID NO: 1933 - protein, 10 aa, Artificial Sequence
  Description of Artificial Sequence: Synthetic peptide
KLVVVGADGV

SEQ ID NO: 1934 - protein, 8 aa, Artificial Sequence
  Description of Artificial Sequence: Synthetic peptide
VGADGVGK

SEQ ID NO: 1935 - protein, 9 aa, Artificial Sequence
  Description of Artificial Sequence: Synthetic peptide
YKLVVVGAD

SEQ ID NO: 1936 - protein, 9 aa, Artificial Sequence
  Description of Artificial Sequence: Synthetic peptide
ADGVGKSAL

SEQ ID NO: 1937 - protein, 10 aa, Artificial Sequence
  Description of Artificial Sequence: Synthetic peptide
DGVGKSALTI

SEQ ID NO: 1938 - protein, 8 aa, Artificial Sequence
  Description of Artificial Sequence: Synthetic peptide
VGADGVGK

SEQ ID NO: 1939 - protein, 23 aa, Artificial Sequence
  Description of Artificial Sequence: Synthetic peptide
MTEYKLVVVGARGVGKSALTIQL

SEQ ID NO: 1940 - protein, 9 aa, Artificial Sequence
  Description of Artificial Sequence: Synthetic peptide
VVGARGVGK

SEQ ID NO: 1941 - protein, 10 aa, Artificial Sequence
  Description of Artificial Sequence: Synthetic peptide
VVVGARGVGK

SEQ ID NO: 1942 - protein, 9 aa, Artificial Sequence
  Description of Artificial Sequence: Synthetic peptide
GARGVGKSA

SEQ ID NO: 1943 - protein, 9 aa, Artificial Sequence
  Description of Artificial Sequence: Synthetic peptide
ARGVGKSAL

SEQ ID NO: 1944 - protein, 9 aa, Artificial Sequence
  Description of Artificial Sequence: Synthetic peptide
GARGVGKSA

SEQ ID NO: 1945 - protein, 8 aa, Artificial Sequence
  Description of Artificial Sequence: Synthetic peptide
RGVGKSAL

SEQ ID NO: 1946 - protein, 9 aa, Artificial Sequence
  Description of Artificial Sequence: Synthetic peptide
VVGARGVGK

SEQ ID NO: 1947 - protein, 9 aa, Artificial Sequence
  Description of Artificial Sequence: Synthetic peptide
ARGVGKSAL

SEQ ID NO: 1948 - protein, 9 aa, Artificial Sequence
  Description of Artificial Sequence: Synthetic peptide
ARGVGKSAL

SEQ ID NO: 1949 - protein, 9 aa, Artificial Sequence
  Description of Artificial Sequence: Synthetic peptide
VVGARGVGK

SEQ ID NO: 1950 - protein, 10 aa, Artificial Sequence
  Description of Artificial Sequence: Synthetic peptide
VVVGARGVGK

SEQ ID NO: 1951 - protein, 10 aa, Artificial Sequence
  Description of Artificial Sequence: Synthetic peptide
GARGVGKSAL

SEQ ID NO: 1952 - protein, 8 aa, Artificial Sequence
  Description of Artificial Sequence: Synthetic peptide
RGVGKSAL

SEQ ID NO: 1953 - protein, 10 aa, Artificial Sequence
  Description of Artificial Sequence: Synthetic peptide
RGVGKSALTI

SEQ ID NO: 1954 - protein, 9 aa, Artificial Sequence
  Description of Artificial Sequence: Synthetic peptide
ARGVGKSAL

SEQ ID NO: 1955 - protein, 9 aa, Artificial Sequence
  Description of Artificial Sequence: Synthetic peptide
GARGVGKSA

SEQ ID NO: 1956 - protein, 10 aa, Artificial Sequence
  Description of Artificial Sequence: Synthetic peptide
GARGVGKSAL

SEQ ID NO: 1957 - protein, 10 aa, Artificial Sequence
  Description of Artificial Sequence: Synthetic peptide
VVVGARGVGK

SEQ ID NO: 1958 - protein, 10 aa, Artificial Sequence
  Description of Artificial Sequence: Synthetic peptide
GARGVGKSAL

SEQ ID NO: 1959 - protein, 9 aa, Artificial Sequence
  Description of Artificial Sequence: Synthetic peptide
LVVVGARGV

SEQ ID NO: 1960 - protein, 8 aa, Artificial Sequence
  Description of Artificial Sequence: Synthetic peptide
RGVGKSAL

SEQ ID NO: 1961 - protein, 9 aa, Artificial Sequence
  Description of Artificial Sequence: Synthetic peptide
VVGARGVGK

SEQ ID NO: 1962 - protein, 10 aa, Artificial Sequence
  Description of Artificial Sequence: Synthetic peptide
KLVVVGARGV

SEQ ID NO: 1963 - protein, 9 aa, Artificial Sequence
  Description of Artificial Sequence: Synthetic peptide
LVVVGARGV

SEQ ID NO: 1964 - protein, 9 aa, Artificial Sequence
  Description of Artificial Sequence: Synthetic peptide
YKLVVVGAR

SEQ ID NO: 1965 - protein, 8 aa, Artificial Sequence
  Description of Artificial Sequence: Synthetic peptide
KLVVVGAR

SEQ ID NO: 1966 - protein, 10 aa, Artificial Sequence
  Description of Artificial Sequence: Synthetic peptide
KLVVVGARGV

SEQ ID NO: 1967 - protein, 8 aa, Artificial Sequence
  Description of Artificial Sequence: Synthetic peptide
RGVGKSAL

SEQ ID NO: 1968 - protein, 9 aa, Artificial Sequence
  Description of Artificial Sequence: Synthetic peptide
LVVVGARGV

SEQ ID NO: 1969 - protein, 8 aa, Artificial Sequence
  Description of Artificial Sequence: Synthetic peptide
VVVGARGV

SEQ ID NO: 1970 - protein, 9 aa, Artificial Sequence
  Description of Artificial Sequence: Synthetic peptide
ARGVGKSAL

SEQ ID NO: 1971 - protein, 9 aa, Artificial Sequence
  Description of Artificial Sequence: Synthetic peptide
ARGVGKSAL

SEQ ID NO: 1972 - protein, 9 aa, Artificial Sequence
  Description of Artificial Sequence: Synthetic peptide
GARGVGKSA

SEQ ID NO: 1973 - protein, 8 aa, Artificial Sequence
  Description of Artificial Sequence: Synthetic peptide
VVVGARGV

SEQ ID NO: 1974 - protein, 23 aa, Artificial Sequence
  Description of Artificial Sequence: Synthetic peptide
MTEYKLVVVGASGVGKSALTIQL

SEQ ID NO: 1975 - protein, 10 aa, Artificial Sequence
  Description of Artificial Sequence: Synthetic peptide
VVVGASGVGK

SEQ ID NO: 1976 - protein, 9 aa, Artificial Sequence
  Description of Artificial Sequence: Synthetic peptide
VVGASGVGK

SEQ ID NO: 1977 - protein, 9 aa, Artificial Sequence
  Description of Artificial Sequence: Synthetic peptide
VVGASGVGK

SEQ ID NO: 1978 - protein, 10 aa, Artificial Sequence
  Description of Artificial Sequence: Synthetic peptide
VVVGASGVGK

SEQ ID NO: 1979 - protein, 9 aa, Artificial Sequence
  Description of Artificial Sequence: Synthetic peptide
ASGVGKSAL

SEQ ID NO: 1980 - protein, 9 aa, Artificial Sequence
  Description of Artificial Sequence: Synthetic peptide
ASGVGKSAL

SEQ ID NO: 1981 - protein, 9 aa, Artificial Sequence
  Description of Artificial Sequence: Synthetic peptide
VVGASGVGK

SEQ ID NO: 1982 - protein, 10 aa, Artificial Sequence
  Description of Artificial Sequence: Synthetic peptide
VVVGASGVGK

SEQ ID NO: 1983 - protein, 9 aa, Artificial Sequence
  Description of Artificial Sequence: Synthetic peptide
ASGVGKSAL

SEQ ID NO: 1984 - protein, 10 aa, Artificial Sequence
  Description of Artificial Sequence: Synthetic peptide
GASGVGKSAL

SEQ ID NO: 1985 - protein, 9 aa, Artificial Sequence
  Description of Artificial Sequence: Synthetic peptide
ASGVGKSAL

SEQ ID NO: 1986 - protein, 9 aa, Artificial Sequence
  Description of Artificial Sequence: Synthetic peptide
ASGVGKSAL

SEQ ID NO: 1987 - protein, 10 aa, Artificial Sequence
  Description of Artificial Sequence: Synthetic peptide
GASGVGKSAL

SEQ ID NO: 1988 - protein, 8 aa, Artificial Sequence
  Description of Artificial Sequence: Synthetic peptide
SGVGKSAL

SEQ ID NO: 1989 - protein, 9 aa, Artificial Sequence
  Description of Artificial Sequence: Synthetic peptide
ASGVGKSAL

SEQ ID NO: 1990 - protein, 9 aa, Artificial Sequence
  Description of Artificial Sequence: Synthetic peptide
ASGVGKSAL

SEQ ID NO: 1991 - protein, 8 aa, Artificial Sequence
  Description of Artificial Sequence: Synthetic peptide
SGVGKSAL

SEQ ID NO: 1992 - protein, 9 aa, Artificial Sequence
  Description of Artificial Sequence: Synthetic peptide
VVGASGVGK

SEQ ID NO: 1993 - protein, 9 aa, Artificial Sequence
  Description of Artificial Sequence: Synthetic peptide
ASGVGKSAL

SEQ ID NO: 1994 - protein, 10 aa, Artificial Sequence
  Description of Artificial Sequence: Synthetic peptide
VVVGASGVGK

SEQ ID NO: 1995 - protein, 10 aa, Artificial Sequence
  Description of Artificial Sequence: Synthetic peptide
GASGVGKSAL

SEQ ID NO: 1996 - protein, 8 aa, Artificial Sequence
  Description of Artificial Sequence: Synthetic peptide
SGVGKSAL

SEQ ID NO: 1997 - protein, 9 aa, Artificial Sequence
  Description of Artificial Sequence: Synthetic peptide
ASGVGKSAL

SEQ ID NO: 1998 - protein, 9 aa, Artificial Sequence
  Description of Artificial Sequence: Synthetic peptide
GASGVGKSA

SEQ ID NO: 1999 - protein, 10 aa, Artificial Sequence
  Description of Artificial Sequence: Synthetic peptide
GASGVGKSAL

SEQ ID NO: 2000 - protein, 10 aa, Artificial Sequence
  Description of Artificial Sequence: Synthetic peptide
KLVVVGASGV

SEQ ID NO: 2001 - protein, 9 aa, Artificial Sequence
  Description of Artificial Sequence: Synthetic peptide
LVVVGASGV

SEQ ID NO: 2002 - protein, 8 aa, Artificial Sequence
  Description of Artificial Sequence: Synthetic peptide
SGVGKSAL

SEQ ID NO: 2003 - protein, 8 aa, Artificial Sequence
  Description of Artificial Sequence: Synthetic peptide
ASGVGKSA

SEQ ID NO: 2004 - protein, 9 aa, Artificial Sequence
  Description of Artificial Sequence: Synthetic peptide
ASGVGKSAL

SEQ ID NO: 2005 - protein, 10 aa, Artificial Sequence
  Description of Artificial Sequence: Synthetic peptide
GASGVGKSAL

SEQ ID NO: 2006 - protein, 8 aa, Artificial Sequence
  Description of Artificial Sequence: Synthetic peptide
SGVGKSAL

SEQ ID NO: 2007 - protein, 9 aa, Artificial Sequence
  Description of Artificial Sequence: Synthetic peptide
ASGVGKSAL

SEQ ID NO: 2008 - protein, 10 aa, Artificial Sequence
  Description of Artificial Sequence: Synthetic peptide
GASGVGKSAL

SEQ ID NO: 2009 - protein, 9 aa, Artificial Sequence
  Description of Artificial Sequence: Synthetic peptide
VVGASGVGK

SEQ ID NO: 2010 - protein, 9 aa, Artificial Sequence
  Description of Artificial Sequence: Synthetic peptide
ASGVGKSAL

SEQ ID NO: 2011 - protein, 10 aa, Artificial Sequence
  Description of Artificial Sequence: Synthetic peptide
GASGVGKSAL

SEQ ID NO: 2012 - protein, 8 aa, Artificial Sequence
  Description of Artificial Sequence: Synthetic peptide
SGVGKSAL

SEQ ID NO: 2013 - protein, 10 aa, Artificial Sequence
  Description of Artificial Sequence: Synthetic peptide
SGVGKSALTI

SEQ ID NO: 2014 - protein, 10 aa, Artificial Sequence
  Description of Artificial Sequence: Synthetic peptide
VGASGVGKSA

SEQ ID NO: 2015 - protein, 9 aa, Artificial Sequence
  Description of Artificial Sequence: Synthetic peptide
ASGVGKSAL

SEQ ID NO: 2016 - protein, 9 aa, Artificial Sequence
  Description of Artificial Sequence: Synthetic peptide
ASGVGKSAL

SEQ ID NO: 2017 - protein, 10 aa, Artificial Sequence
  Description of Artificial Sequence: Synthetic peptide
KLVVVGASGV

SEQ ID NO: 2018 - protein, 8 aa, Artificial Sequence
  Description of Artificial Sequence: Synthetic peptide
SGVGKSAL

SEQ ID NO: 2019 - protein, 9 aa, Artificial Sequence
  Description of Artificial Sequence: Synthetic peptide
ASGVGKSAL

SEQ ID NO: 2020 - protein, 9 aa, Artificial Sequence
  Description of Artificial Sequence: Synthetic peptide
KLVVVGASG

SEQ ID NO: 2021 - protein, 23 aa, Artificial Sequence
  Description of Artificial Sequence: Synthetic peptide
MTEYKLVVVGAVGVGKSALTIQL

SEQ ID NO: 2022 - protein, 9 aa, Artificial Sequence
  Description of Artificial Sequence: Synthetic peptide
VVGAVGVGK

SEQ ID NO: 2023 - protein, 9 aa, Artificial Sequence
  Description of Artificial Sequence: Synthetic peptide
VVGAVGVGK

SEQ ID NO: 2024 - protein, 10 aa, Artificial Sequence
  Description of Artificial Sequence: Synthetic peptide
VVVGAVGVGK

SEQ ID NO: 2025 - protein, 10 aa, Artificial Sequence
  Description of Artificial Sequence: Synthetic peptide
VVVGAVGVGK

SEQ ID NO: 2026 - protein, 9 aa, Artificial Sequence
  Description of Artificial Sequence: Synthetic peptide
VVGAVGVGK

SEQ ID NO: 2027 - protein, 9 aa, Artificial Sequence
  Description of Artificial Sequence: Synthetic peptide
LVVVGAVGV

SEQ ID NO: 2028 - protein, 9 aa, Artificial Sequence
  Description of Artificial Sequence: Synthetic peptide
VVGAVGVGK

SEQ ID NO: 2029 - protein, 9 aa, Artificial Sequence
  Description of Artificial Sequence: Synthetic peptide
AVGVGKSAL

SEQ ID NO: 2030 - protein, 10 aa, Artificial Sequence
  Description of Artificial Sequence: Synthetic peptide
KLVVVGAVGV

SEQ ID NO: 2031 - protein, 9 aa, Artificial Sequence
  Description of Artificial Sequence: Synthetic peptide
AVGVGKSAL

SEQ ID NO: 2032 - protein, 10 aa, Artificial Sequence
  Description of Artificial Sequence: Synthetic peptide
GAVGVGKSAL

SEQ ID NO: 2033 - protein, 10 aa, Artificial Sequence
  Description of Artificial Sequence: Synthetic peptide
GAVGVGKSAL

SEQ ID NO: 2034 - protein, 10 aa, Artificial Sequence
  Description of Artificial Sequence: Synthetic peptide
VVVGAVGVGK

SEQ ID NO: 2035 - protein, 9 aa, Artificial Sequence
  Description of Artificial Sequence: Synthetic peptide
AVGVGKSAL

SEQ ID NO: 2036 - protein, 10 aa, Artificial Sequence
  Description of Artificial Sequence: Synthetic peptide
GAVGVGKSAL

SEQ ID NO: 2037 - protein, 10 aa, Artificial Sequence
  Description of Artificial Sequence: Synthetic peptide
KLVVVGAVGV

SEQ ID NO: 2038 - protein, 8 aa, Artificial Sequence
  Description of Artificial Sequence: Synthetic peptide
VGVGKSAL

SEQ ID NO: 2039 - protein, 8 aa, Artificial Sequence
  Description of Artificial Sequence: Synthetic peptide
VVVGAVGV

SEQ ID NO: 2040 - protein, 9 aa, Artificial Sequence
  Description of Artificial Sequence: Synthetic peptide
AVGVGKSAL

SEQ ID NO: 2041 - protein, 9 aa, Artificial Sequence
  Description of Artificial Sequence: Synthetic peptide
AVGVGKSAL

SEQ ID NO: 2042 - protein, 10 aa, Artificial Sequence
  Description of Artificial Sequence: Synthetic peptide
GAVGVGKSAL

SEQ ID NO: 2043 - protein, 9 aa, Artificial Sequence
  Description of Artificial Sequence: Synthetic peptide
AVGVGKSAL

SEQ ID NO: 2044 - protein, 9 aa, Artificial Sequence
  Description of Artificial Sequence: Synthetic peptide
AVGVGKSAL

SEQ ID NO: 2045 - protein, 9 aa, Artificial Sequence
  Description of Artificial Sequence: Synthetic peptide
GAVGVGKSA

SEQ ID NO: 2046 - protein, 10 aa, Artificial Sequence
  Description of Artificial Sequence: Synthetic peptide
GAVGVGKSAL

SEQ ID NO: 2047 - protein, 10 aa, Artificial Sequence
  Description of Artificial Sequence: Synthetic peptide
GAVGVGKSAL

SEQ ID NO: 2048 - protein, 10 aa, Artificial Sequence
  Description of Artificial Sequence: Synthetic peptide
KLVVVGAVGV

SEQ ID NO: 2049 - protein, 8 aa, Artificial Sequence
  Description of Artificial Sequence: Synthetic peptide
VGVGKSAL

SEQ ID NO: 2050 - protein, 9 aa, Artificial Sequence
  Description of Artificial Sequence: Synthetic peptide
AVGVGKSAL

SEQ ID NO: 2051 - protein, 9 aa, Artificial Sequence
  Description of Artificial Sequence: Synthetic peptide
GAVGVGKSA

SEQ ID NO: 2052 - protein, 8 aa, Artificial Sequence
  Description of Artificial Sequence: Synthetic peptide
VGVGKSAL

SEQ ID NO: 2053 - protein, 10 aa, Artificial Sequence
  Description of Artificial Sequence: Synthetic peptide
VGVGKSALTI

SEQ ID NO: 2054 - protein, 9 aa, Artificial Sequence
  Description of Artificial Sequence: Synthetic peptide
GAVGVGKSA

SEQ ID NO: 2055 - protein, 8 aa, Artificial Sequence
  Description of Artificial Sequence: Synthetic peptide
VGVGKSAL

SEQ ID NO: 2056 - protein, 9 aa, Artificial Sequence
  Description of Artificial Sequence: Synthetic peptide
AVGVGKSAL

SEQ ID NO: 2057 - protein, 9 aa, Artificial Sequence
  Description of Artificial Sequence: Synthetic peptide
AVGVGKSAL

SEQ ID NO: 2058 - protein, 9 aa, Artificial Sequence
  Description of Artificial Sequence: Synthetic peptide
AVGVGKSAL

SEQ ID NO: 2059 - protein, 9 aa, Artificial Sequence
  Description of Artificial Sequence: Synthetic peptide
LVVVGAVGV

SEQ ID NO: 2060 - protein, 8 aa, Artificial Sequence
  Description of Artificial Sequence: Synthetic peptide
VGVGKSAL

SEQ ID NO: 2061 - protein, 9 aa, Artificial Sequence
  Description of Artificial Sequence: Synthetic peptide
VVGAVGVGK

SEQ ID NO: 2062 - protein, 9 aa, Artificial Sequence
  Description of Artificial Sequence: Synthetic peptide
AVGVGKSAL

SEQ ID NO: 2063 - protein, 9 aa, Artificial Sequence
  Description of Artificial Sequence: Synthetic peptide
AVGVGKSAL

SEQ ID NO: 2064 - protein, 9 aa, Artificial Sequence
  Description of Artificial Sequence: Synthetic peptide
GAVGVGKSA

SEQ ID NO: 2065 - protein, 10 aa, Artificial Sequence
  Description of Artificial Sequence: Synthetic peptide
KLVVVGAVGV

SEQ ID NO: 2066 - protein, 9 aa, Artificial Sequence
  Description of Artificial Sequence: Synthetic peptide
LVVVGAVGV

SEQ ID NO: 2067 - protein, 8 aa, Artificial Sequence
  Description of Artificial Sequence: Synthetic peptide
VGVGKSAL

SEQ ID NO: 2068 - protein, 10 aa, Artificial Sequence
  Description of Artificial Sequence: Synthetic peptide
VVVGAVGVGK

SEQ ID NO: 2069 - protein, 9 aa, Artificial Sequence
  Description of Artificial Sequence: Synthetic peptide
VVGAVGVGK

SEQ ID NO: 2070 - protein, 8 aa, Artificial Sequence
  Description of Artificial Sequence: Synthetic peptide
VVVGAVGV

SEQ ID NO: 2071 - protein, 9 aa, Artificial Sequence
  Description of Artificial Sequence: Synthetic peptide
AVGVGKSAL

SEQ ID NO: 2072 - protein, 9 aa, Artificial Sequence
  Description of Artificial Sequence: Synthetic peptide
AVGVGKSAL

SEQ ID NO: 2073 - protein, 9 aa, Artificial Sequence
  Description of Artificial Sequence: Synthetic peptide
LVVVGAVGV

SEQ ID NO: 2074 - protein, 8 aa, Artificial Sequence
  Description of Artificial Sequence: Synthetic peptide
AVGVGKSA

SEQ ID NO: 2075 - protein, 9 aa, Artificial Sequence
  Description of Artificial Sequence: Synthetic peptide
AVGVGKSAL

SEQ ID NO: 2076 - protein, 9 aa, Artificial Sequence
  Description of Artificial Sequence: Synthetic peptide
GAVGVGKSA

SEQ ID NO: 2077 - protein, 10 aa, Artificial Sequence
  Description of Artificial Sequence: Synthetic peptide
GAVGVGKSAL

SEQ ID NO: 2078 - protein, 9 aa, Artificial Sequence
  Description of Artificial Sequence: Synthetic peptide
YKLVVVGAV

SEQ ID NO: 2079 - protein, 10 aa, Artificial Sequence
  Description of Artificial Sequence: Synthetic peptide
GAVGVGKSAL

SEQ ID NO: 2080 - protein, 9 aa, Artificial Sequence
  Description of Artificial Sequence: Synthetic peptide
VVGAVGVGK

SEQ ID NO: 2081 - protein, 9 aa, Artificial Sequence
  Description of Artificial Sequence: Synthetic peptide
YKLVVVGAV

SEQ ID NO: 2082 - protein, 23 aa, Artificial Sequence
  Description of Artificial Sequence: Synthetic peptide
MTEYKLVVVGAGCVGKSALTIQL

SEQ ID NO: 2083 - protein, 10 aa, Artificial Sequence
  Description of Artificial Sequence: Synthetic peptide
VVVGAGCVGK

SEQ ID NO: 2084 - protein, 9 aa, Artificial Sequence
  Description of Artificial Sequence: Synthetic peptide
VVGAGCVGK

SEQ ID NO: 2085 - protein, 9 aa, Artificial Sequence
  Description of Artificial Sequence: Synthetic peptide
AGCVGKSAL

SEQ ID NO: 2086 - protein, 9 aa, Artificial Sequence
  Description of Artificial Sequence: Synthetic peptide
VVGAGCVGK

SEQ ID NO: 2087 - protein, 10 aa, Artificial Sequence
  Description of Artificial Sequence: Synthetic peptide
VVVGAGCVGK

SEQ ID NO: 2088 - protein, 9 aa, Artificial Sequence
  Description of Artificial Sequence: Synthetic peptide
CVGKSALTI

SEQ ID NO: 2089 - protein, 9 aa, Artificial Sequence
  Description of Artificial Sequence: Synthetic peptide
VVGAGCVGK

SEQ ID NO: 2090 - protein, 9 aa, Artificial Sequence
  Description of Artificial Sequence: Synthetic peptide
VVGAGCVGK

SEQ ID NO: 2091 - protein, 9 aa, Artificial Sequence
  Description of Artificial Sequence: Synthetic peptide
AGCVGKSAL

SEQ ID NO: 2092 - protein, 9 aa, Artificial Sequence
  Description of Artificial Sequence: Synthetic peptide
AGCVGKSAL

SEQ ID NO: 2093 - protein, 10 aa, Artificial Sequence
  Description of Artificial Sequence: Synthetic peptide
GCVGKSALTI

SEQ ID NO: 2094 - protein, 9 aa, Artificial Sequence
  Description of Artificial Sequence: Synthetic peptide
AGCVGKSAL

SEQ ID NO: 2095 - protein, 10 aa, Artificial Sequence
  Description of Artificial Sequence: Synthetic peptide
VVVGAGCVGK

SEQ ID NO: 2096 - protein, 9 aa, Artificial Sequence
  Description of Artificial Sequence: Synthetic peptide
KLVVVGAGC

SEQ ID NO: 2097 - protein, 8 aa, Artificial Sequence
  Description of Artificial Sequence: Synthetic peptide
GCVGKSAL

SEQ ID NO: 2098 - protein, 9 aa, Artificial Sequence
  Description of Artificial Sequence: Synthetic peptide
VVGAGCVGK

SEQ ID NO: 2099 - protein, 9 aa, Artificial Sequence
  Description of Artificial Sequence: Synthetic peptide
AGCVGKSAL

SEQ ID NO: 2100 - protein, 9 aa, Artificial Sequence
  Description of Artificial Sequence: Synthetic peptide
KLVVVGAGC

SEQ ID NO: 2101 - protein, 23 aa, Artificial Sequence
  Description of Artificial Sequence: Synthetic peptide
MTEYKLVVVGAGDVGKSALTIQL

SEQ ID NO: 2102 - protein, 9 aa, Artificial Sequence
  Description of Artificial Sequence: Synthetic peptide
AGDVGKSAL

SEQ ID NO: 2103 - protein, 9 aa, Artificial Sequence
  Description of Artificial Sequence: Synthetic peptide
AGDVGKSAL

SEQ ID NO: 2104 - protein, 9 aa, Artificial Sequence
  Description of Artificial Sequence: Synthetic peptide
VVGAGDVGK

SEQ ID NO: 2105 - protein, 10 aa, Artificial Sequence
  Description of Artificial Sequence: Synthetic peptide
VVVGAGDVGK

SEQ ID NO: 2106 - protein, 10 aa, Artificial Sequence
  Description of Artificial Sequence: Synthetic peptide
VVVGAGDVGK

SEQ ID NO: 2107 - protein, 9 aa, Artificial Sequence
  Description of Artificial Sequence: Synthetic peptide
GAGDVGKSA

SEQ ID NO: 2108 - protein, 10 aa, Artificial Sequence
  Description of Artificial Sequence: Synthetic peptide
GAGDVGKSAL

SEQ ID NO: 2109 - protein, 9 aa, Artificial Sequence
  Description of Artificial Sequence: Synthetic peptide
VVGAGDVGK

SEQ ID NO: 2110 - protein, 9 aa, Artificial Sequence
  Description of Artificial Sequence: Synthetic peptide
VVGAGDVGK

SEQ ID NO: 2111 - protein, 9 aa, Artificial Sequence
  Description of Artificial Sequence: Synthetic peptide
AGDVGKSAL

SEQ ID NO: 2112 - protein, 9 aa, Artificial Sequence
  Description of Artificial Sequence: Synthetic peptide
AGDVGKSAL

SEQ ID NO: 2113 - protein, 9 aa, Artificial Sequence
  Description of Artificial Sequence: Synthetic peptide
AGDVGKSAL

SEQ ID NO: 2114 - protein, 9 aa, Artificial Sequence
  Description of Artificial Sequence: Synthetic peptide
DVGKSALTI

SEQ ID NO: 2115 - protein, 9 aa, Artificial Sequence
  Description of Artificial Sequence: Synthetic peptide
DVGKSALTI

SEQ ID NO: 2116 - protein, 8 aa, Artificial Sequence
  Description of Artificial Sequence: Synthetic peptide
GDVGKSAL

SEQ ID NO: 2117 - protein, 8 aa, Artificial Sequence
  Description of Artificial Sequence: Synthetic peptide
GDVGKSAL

SEQ ID NO: 2118 - protein, 8 aa, Artificial Sequence
  Description of Artificial Sequence: Synthetic peptide
GDVGKSAL

SEQ ID NO: 2119 - protein, 9 aa, Artificial Sequence
  Description of Artificial Sequence: Synthetic peptide
AGDVGKSAL

SEQ ID NO: 2120 - protein, 9 aa, Artificial Sequence
  Description of Artificial Sequence: Synthetic peptide
DVGKSALTI

SEQ ID NO: 2121 - protein, 9 aa, Artificial Sequence
  Description of Artificial Sequence: Synthetic peptide
VVGAGDVGK

SEQ ID NO: 2122 - protein, 10 aa, Artificial Sequence
  Description of Artificial Sequence: Synthetic peptide
GAGDVGKSAL

SEQ ID NO: 2123 - protein, 10 aa, Artificial Sequence
  Description of Artificial Sequence: Synthetic peptide
GAGDVGKSAL

SEQ ID NO: 2124 - protein, 9 aa, Artificial Sequence
  Description of Artificial Sequence: Synthetic peptide
AGDVGKSAL

SEQ ID NO: 2125 - protein, 10 aa, Artificial Sequence
  Description of Artificial Sequence: Synthetic peptide
GAGDVGKSAL

SEQ ID NO: 2126 - protein, 9 aa, Artificial Sequence
  Description of Artificial Sequence: Synthetic peptide
DVGKSALTI

SEQ ID NO: 2127 - protein, 9 aa, Artificial Sequence
  Description of Artificial Sequence: Synthetic peptide
AGDVGKSAL

SEQ ID NO: 2128 - protein, 9 aa, Artificial Sequence
  Description of Artificial Sequence: Synthetic peptide
AGDVGKSAL

SEQ ID NO: 2129 - protein, 9 aa, Artificial Sequence
  Description of Artificial Sequence: Synthetic peptide
DVGKSALTI

SEQ ID NO: 2130 - protein, 9 aa, Artificial Sequence
  Description of Artificial Sequence: Synthetic peptide
VVGAGDVGK

SEQ ID NO: 2131 - protein, 9 aa, Artificial Sequence
  Description of Artificial Sequence: Synthetic peptide
GAGDVGKSA

SEQ ID NO: 2132 - protein, 9 aa, Artificial Sequence
  Description of Artificial Sequence: Synthetic peptide
DVGKSALTI

SEQ ID NO: 2133 - protein, 10 aa, Artificial Sequence
  Description of Artificial Sequence: Synthetic peptide
GAGDVGKSAL

SEQ ID NO: 2134 - protein, 10 aa, Artificial Sequence
  Description of Artificial Sequence: Synthetic peptide
VVVGAGDVGK

SEQ ID NO: 2135 - protein, 64 aa, Artificial Sequence; identical to SEQ ID NO: 1564
  Description of Artificial Sequence: Synthetic polypeptide

SEQ ID NO: 2136 - protein, 10 aa, Artificial Sequence
  Description of Artificial Sequence: Synthetic peptide
ALNSEALSVV

SEQ ID NO: 2137 - protein, 10 aa, Artificial Sequence
  Description of Artificial Sequence: Synthetic peptide
MALNSEALSV

SEQ ID NO: 2138 - protein, 62 aa, Artificial Sequence; identical to SEQ ID NO: 1213
  Description of Artificial Sequence: Synthetic polypeptide

SEQ ID NO: 2139 - protein, 10 aa, Artificial Sequence
  Description of Artificial Sequence: Synthetic peptide
KLVVVGACGV

SEQ ID NO: 2140 - protein, 9 aa, Artificial Sequence
  Description of Artificial Sequence: Synthetic peptide
LVVVGACGV

SEQ ID NO: 2141 - protein, 9 aa, Artificial Sequence
  Description of Artificial Sequence: Synthetic peptide
VVGACGVGK

SEQ ID NO: 2142 - protein, 10 aa, Artificial Sequence
  Description of Artificial Sequence: Synthetic peptide
VVVGACGVGK

SEQ ID NO: 2143 - protein, 71 aa, Artificial Sequence
  Description of Artificial Sequence: Synthetic polypeptide
MTEYKLVVVGADGVGKSALTIQLIQNHFVDEYDPTIEDSYRKQVVIDGETCLLDILDTAGQEVVGADGVGK

SEQ ID NO: 2144 - protein, 10 aa, Artificial Sequence
  Description of Artificial Sequence: Synthetic peptide
VVVGADGVGK

SEQ ID NO: 2145 - protein, 10 aa, Artificial Sequence
  Description of Artificial Sequence: Synthetic peptide
KLVVVGADGV

SEQ ID NO: 2146 - protein, 9 aa, Artificial Sequence
  Description of Artificial Sequence: Synthetic peptide
LVVVGADGV

SEQ ID NO: 2147 - protein, 62 aa, Artificial Sequence; identical to SEQ ID NO: 1215
  Description of Artificial Sequence: Synthetic polypeptide

SEQ ID NO: 2148 - protein, 10 aa, Artificial Sequence
  Description of Artificial Sequence: Synthetic peptide
KLVVVGAVGV

SEQ ID NO: 2149 - protein, 9 aa, Artificial Sequence
  Description of Artificial Sequence: Synthetic peptide
LVVVGAVGV

SEQ ID NO: 2150 - protein, 9 aa, Artificial Sequence
  Description of Artificial Sequence: Synthetic peptide
VVGAVGVGK

SEQ ID NO: 2151 - protein, 10 aa, Artificial Sequence
  Description of Artificial Sequence: Synthetic peptide
VVVGAVGVGK

SEQ ID NO: 2152 - protein, 101 aa, Artificial Sequence; identical to SEQ ID NO: 1216
  Description of Artificial Sequence: Synthetic polypeptide

SEQ ID NO: 2153 - protein, 10 aa, Artificial Sequence
  Description of Artificial Sequence: Synthetic peptide
ILDTAGHEEY

SEQ ID NO: 2154 - protein, 101 aa, Artificial Sequence; identical to SEQ ID NO: 1217
  Description of Artificial Sequence: Synthetic polypeptide

SEQ ID NO: 2155 - protein, 10 aa, Artificial Sequence
  Description of Artificial Sequence: Synthetic peptide
ILDTAGLEEY

SEQ ID NO: 2156 - protein, 10 aa, Artificial Sequence
  Description of Artificial Sequence: Synthetic peptide
LLDILDTAGL

SEQ ID NO: 2157 - protein, 101 aa, Artificial Sequence; identical to SEQ ID NO: 1218
  Description of Artificial Sequence: Synthetic polypeptide

SEQ ID NO: 2158 - protein, 10 aa, Artificial Sequence
  Description of Artificial Sequence: Synthetic peptide
ILDTAGKEEY

SEQ ID NO: 2159 - protein, 101 aa, Artificial Sequence; identical to SEQ ID NO: 1219
  Description of Artificial Sequence: Synthetic polypeptide

SEQ ID NO: 2160 - protein, 10 aa, Artificial Sequence
  Description of Artificial Sequence: Synthetic peptide
ILDTAGREEY

SEQ ID NO: 2161 - protein, 8 aa, Artificial Sequence
  Description of Artificial Sequence: Synthetic peptide
DTAGHEEY

SEQ ID NO: 2162 - protein, 10 aa, Artificial Sequence
  Description of Artificial Sequence: Synthetic peptide
TAGHEEYSAM

SEQ ID NO: 2163 - protein, 9 aa, Artificial Sequence
  Description of Artificial Sequence: Synthetic peptide
DILDTAGHE

SEQ ID NO: 2164 - protein, 8 aa, Artificial Sequence
  Description of Artificial Sequence: Synthetic peptide
DILDTAGH

SEQ ID NO: 2165 - protein, 9 aa, Artificial Sequence
  Description of Artificial Sequence: Synthetic peptide
ILDTAGHEE

SEQ ID NO: 2166 - protein, 8 aa, Artificial Sequence
  Description of Artificial Sequence: Synthetic peptide
ILDTAGHE

SEQ ID NO: 2167 - protein, 11 aa, Artificial Sequence
  Description of Artificial Sequence: Synthetic peptide
DILDTAGHEEY

SEQ ID NO: 2168 - protein, 9 aa, Artificial Sequence
  Description of Artificial Sequence: Synthetic peptide
DTAGHEEYS

SEQ ID NO: 2169 - protein, 10 aa, Artificial Sequence
  Description of Artificial Sequence: Synthetic peptide
LLDILDTAGH

SEQ ID NO: 2170 - protein, 9 aa, Artificial Sequence
  Description of Artificial Sequence: Synthetic peptide
DILDTAGRE

SEQ ID NO: 2171 - protein, 8 aa, Artificial Sequence
  Description of Artificial Sequence: Synthetic peptide
DILDTAGR

SEQ ID NO: 2172 - protein, 9 aa, Artificial Sequence
  Description of Artificial Sequence: Synthetic peptide
ILDTAGREE

SEQ ID NO: 2173 - protein, 8 aa, Artificial Sequence
  Description of Artificial Sequence: Synthetic peptide
ILDTAGRE

SEQ ID NO: 2174 - protein, 11 aa, Artificial Sequence
  Description of Artificial Sequence: Synthetic peptide
CLLDILDTAGR

SEQ ID NO: 2175 - protein, 10 aa, Artificial Sequence
  Description of Artificial Sequence: Synthetic peptide
TAGREEYSAM

SEQ ID NO: 2176 - protein, 9 aa, Artificial Sequence
  Description of Artificial Sequence: Synthetic peptide
REEYSAMRD

SEQ ID NO: 2177 - protein, 11 aa, Artificial Sequence
  Description of Artificial Sequence: Synthetic peptide
DTAGKEEYSAM

SEQ ID NO: 2178 - protein, 11 aa, Artificial Sequence
  Description of Artificial Sequence: Synthetic peptide
CLLDILDTAGK

SEQ ID NO: 2179 - protein, 8 aa, Artificial Sequence
  Description of Artificial Sequence: Synthetic peptide
DTAGKEEY

SEQ ID NO: 2180 - protein, 10 aa, Artificial Sequence
  Description of Artificial Sequence: Synthetic peptide
LLDILDTAGK

SEQ ID NO: 2181 - protein, 8 aa, Artificial Sequence
  Description of Artificial Sequence: Synthetic peptide
ILDTAGKE

SEQ ID NO: 2182 - protein, 9 aa, Artificial Sequence
  Description of Artificial Sequence: Synthetic peptide
ILDTAGKEE

SEQ ID NO: 2183 - protein, 8 aa, Artificial Sequence
  Description of Artificial Sequence: Synthetic peptide
DTAGLEEY

SEQ ID NO: 2184 - protein, 8 aa, Artificial Sequence
  Description of Artificial Sequence: Synthetic peptide
ILDTAGLE

SEQ ID NO: 2185 - protein, 8 aa, Artificial Sequence
  Description of Artificial Sequence: Synthetic peptide
DILDTAGL

SEQ ID NO: 2186 - protein, 9 aa, Artificial Sequence
  Description of Artificial Sequence: Synthetic peptide
ILDTAGLEE

SEQ ID NO: 2187 - protein, 12 aa, Artificial Sequence
  Description of Artificial Sequence: Synthetic peptide
GLEEYSAMRDQY

SEQ ID NO: 2188 - protein, 11 aa, Artificial Sequence
  Description of Artificial Sequence: Synthetic peptide
LLDILDTAGLE

SEQ ID NO: 2189 - protein, 9 aa, Artificial Sequence
  Description of Artificial Sequence: Synthetic peptide
LDILDTAGL

SEQ ID NO: 2190 - protein, 9 aa, Artificial Sequence
  Description of Artificial Sequence: Synthetic peptide
DILDTAGLE

SEQ ID NO: 2191 - protein, 11 aa, Artificial Sequence
  Description of Artificial Sequence: Synthetic peptide
DILDTAGLEEY

SEQ ID NO: 2192 - protein, 8 aa, Artificial Sequence
  Description of Artificial Sequence: Synthetic peptide
AGVGKSAL

SEQ ID NO: 2193 - protein, 10 aa, Artificial Sequence
  Description of Artificial Sequence: Synthetic peptide
GAAGVGKSAL

SEQ ID NO: 2194 - protein, 9 aa, Artificial Sequence
  Description of Artificial Sequence: Synthetic peptide
AAGVGKSAL

SEQ ID NO: 2195 - protein, 8 aa, Artificial Sequence
  Description of Artificial Sequence: Synthetic peptide
CGVGKSAL

SEQ ID NO: 2196 - protein, 9 aa, Artificial Sequence
  Description of Artificial Sequence: Synthetic peptide
ACGVGKSAL

SEQ ID NO: 2197 - protein, 8 aa, Artificial Sequence
  Description of Artificial Sequence: Synthetic peptide
DGVGKSAL

SEQ ID NO: 2198 - protein, 9 aa, Artificial Sequence
  Description of Artificial Sequence: Synthetic peptide
ADGVGKSAL

SEQ ID NO: 2199 - protein, 10 aa, Artificial Sequence
  Description of Artificial Sequence: Synthetic peptide
DGVGKSALTI

SEQ ID NO: 2200 - protein, 9 aa, Artificial Sequence
  Description of Artificial Sequence: Synthetic peptide
GARGVGKSA

SEQ ID NO: 2201 - protein, 10 aa, Artificial Sequence
  Description of Artificial Sequence: Synthetic peptide
KLVVVGARGV

SEQ ID NO: 2202 - protein, 8 aa, Artificial Sequence
  Description of Artificial Sequence: Synthetic peptide
VVVGARGV

SEQ ID NO: 2203 - protein, 8 aa, Artificial Sequence
  Description of Artificial Sequence: Synthetic peptide
SGVGKSAL

SEQ ID NO: 2204 - protein, 10 aa, Artificial Sequence
  Description of Artificial Sequence: Synthetic peptide
VVVGASGVGK

SEQ ID NO: 2205 - protein, 10 aa, Artificial Sequence
  Description of Artificial Sequence: Synthetic peptide
GASGVGKSAL

SEQ ID NO: 2206 - protein, 8 aa, Artificial Sequence
  Description of Artificial Sequence: Synthetic peptide
VGVGKSAL

SEQ ID NO: 2207 - protein, 10 aa, Artificial Sequence
  Description of Artificial Sequence: Synthetic peptide
VVVGAGCVGK

SEQ ID NO: 2208 - protein, 9 aa, Artificial Sequence
  Description of Artificial Sequence: Synthetic peptide
KLVVVGAGC

SEQ ID NO: 2209 - protein, 8 aa, Artificial Sequence
  Description of Artificial Sequence: Synthetic peptide
GDVGKSAL

SEQ ID NO: 2210 - protein, 9 aa, Artificial Sequence
  Description of Artificial Sequence: Synthetic peptide
DVGKSALTI

SEQ ID NO: 2211 - protein, 10 aa, Artificial Sequence
  Description of Artificial Sequence: Synthetic peptide
VVVGAGDVGK

SEQ ID NO: 2212 - protein, 10 aa, Artificial Sequence
  Description of Artificial Sequence: Synthetic peptide
TAGKEEYSAM

SEQ ID NO: 2213 - protein, 11 aa, Artificial Sequence
  Description of Artificial Sequence: Synthetic peptide
DTAGHEEYSAM

SEQ ID NO: 2214 - protein, 9 aa, Artificial Sequence
  Description of Artificial Sequence: Synthetic peptide
TAGHEEYSA

SEQ ID NO: 2215 - protein, 11 aa, Artificial Sequence
  Description of Artificial Sequence: Synthetic peptide
DTAGREEYSAM

SEQ ID NO: 2216 - protein, 9 aa, Artificial Sequence
  Description of Artificial Sequence: Synthetic peptide
TAGKEEYSA

SEQ ID NO: 2217 - protein, 8 aa, Artificial Sequence
  Description of Artificial Sequence: Synthetic peptide
AAGVGKSA

SEQ ID NO: 2218 - protein, 9 aa, Artificial Sequence
  Description of Artificial Sequence: Synthetic peptide
AGCVGKSAL

SEQ ID NO: 2219 - protein, 9 aa, Artificial Sequence
  Description of Artificial Sequence: Synthetic peptide
AGDVGKSAL

SEQ ID NO: 2220 - protein, 10 aa, Artificial Sequence
  Description of Artificial Sequence: Synthetic peptide
AGKEEYSAMR

SEQ ID NO: 2221 - protein, 10 aa, Artificial Sequence
  Description of Artificial Sequence: Synthetic peptide
AGVGKSALTI

SEQ ID NO: 2222 - protein, 9 aa, Artificial Sequence
  Description of Artificial Sequence: Synthetic peptide
ARGVGKSAL

SEQ ID NO: 2223 - protein, 8 aa, Artificial Sequence
  Description of Artificial Sequence: Synthetic peptide
ASGVGKSA

SEQ ID NO: 2224 - protein, 9 aa, Artificial Sequence
  Description of Artificial Sequence: Synthetic peptide
ASGVGKSAL

SEQ ID NO: 2225 - protein, 8 aa, Artificial Sequence
  Description of Artificial Sequence: Synthetic peptide
AVGVGKSA

SEQ ID NO: 2226 - protein, 9 aa, Artificial Sequence
  Description of Artificial Sequence: Synthetic peptide
CVGKSALTI

SEQ ID NO: 2227 - protein, 8 aa, Artificial Sequence
  Description of Artificial Sequence: Synthetic peptide
DILDTAGK

SEQ ID NO: 2228 - protein, 11 aa, Artificial Sequence
  Description of Artificial Sequence: Synthetic peptide
DILDTAGREEY

SEQ ID NO: 2229 - protein, 12 aa, Artificial Sequence
  Description of Artificial Sequence: Synthetic peptide
DTAGHEEYSAMR

SEQ ID NO: 2230 - protein, 9 aa, Artificial Sequence
  Description of Artificial Sequence: Synthetic peptide
DTAGKEEYS

SEQ ID NO: 2231 - protein, 12 aa, Artificial Sequence
  Description of Artificial Sequence: Synthetic peptide
DTAGKEEYSAMR

SEQ ID NO: 2232 - protein, 9 aa, Artificial Sequence
  Description of Artificial Sequence: Synthetic peptide
DTAGLEEYS

SEQ ID NO: 2233 - protein, 10 aa, Artificial Sequence
  Description of Artificial Sequence: Synthetic peptide
DTAGLEEYSA

SEQ ID NO: 2234 - protein, 12 aa, Artificial Sequence
  Description of Artificial Sequence: Synthetic peptide
DTAGLEEYSAMR

SEQ ID NO: 2235 - protein, 9 aa, Artificial Sequence
  Description of Artificial Sequence: Synthetic peptide
DTAGREEYS

SEQ ID NO: 2236 - protein, 12 aa, Artificial Sequence
  Description of Artificial Sequence: Synthetic peptide
DTAGREEYSAMR

SEQ ID NO: 2237 - protein, 9 aa, Artificial Sequence
  Description of Artificial Sequence: Synthetic peptide
GAAGVGKSA

SEQ ID NO: 2238 - protein, 9 aa, Artificial Sequence
  Description of Artificial Sequence: Synthetic peptide
GACGVGKSA

SEQ ID NO: 2239 - protein, 10 aa, Artificial Sequence
  Description of Artificial Sequence: Synthetic peptide
GACGVGKSAL

SEQ ID NO: 2240 - protein, 8 aa, Artificial Sequence
  Description of Artificial Sequence: Synthetic peptide
GADGVGKS

SEQ ID NO: 2241 - protein, 9 aa, Artificial Sequence
  Description of Artificial Sequence: Synthetic peptide
GAGDVGKSA

SEQ ID NO: 2242 - protein, 10 aa, Artificial Sequence
  Description of Artificial Sequence: Synthetic peptide
GAGDVGKSAL

SEQ ID NO: 2243 - protein, 9 aa, Artificial Sequence
  Description of Artificial Sequence: Synthetic peptide
GASGVGKSA

SEQ ID NO: 2244 - protein, 8 aa, Artificial Sequence
  Description of Artificial Sequence: Synthetic peptide
GCVGKSAL

SEQ ID NO: 2245 - protein, 10 aa, Artificial Sequence
  Description of Artificial Sequence: Synthetic peptide
GCVGKSALTI

SEQ ID NO: 2246 - protein, 8 aa, Artificial Sequence
  Description of Artificial Sequence: Synthetic peptide
GHEEYSAM

SEQ ID NO: 2247 - protein, 8 aa, Artificial Sequence
  Description of Artificial Sequence: Synthetic peptide
GKEEYSAM

SEQ ID NO: 2248 - protein, 9 aa, Artificial Sequence
  Description of Artificial Sequence: Synthetic peptide
GLEEYSAMR

SEQ ID NO: 2249 - protein, 8 aa, Artificial Sequence
  Description of Artificial Sequence: Synthetic peptide
GREEYSAM

SEQ ID NO: 2250 - protein, 9 aa, Artificial Sequence
  Description of Artificial Sequence: Synthetic peptide
GREEYSAMR

SEQ ID NO: 2251 - protein, 9 aa, Artificial Sequence
  Description of Artificial Sequence: Synthetic peptide
HEEYSAMRD

SEQ ID NO: 2252 - protein, 9 aa, Artificial Sequence
  Description of Artificial Sequence: Synthetic peptide
KEEYSAMRD

SEQ ID NO: 2253 - protein, 9 aa, Artificial Sequence
  Description of Artificial Sequence: Synthetic peptide
KLVVVGASG

SEQ ID NO: 2254 - protein, 9 aa, Artificial Sequence
  Description of Artificial Sequence: Synthetic peptide
LDILDTAGR

SEQ ID NO: 2255 - protein, 9 aa, Artificial Sequence
  Description of Artificial Sequence: Synthetic peptide
LEEYSAMRD

SEQ ID NO: 2256 - protein, 9 aa, Artificial Sequence
  Description of Artificial Sequence: Synthetic peptide
LVVVGARGV

SEQ ID NO: 2257 - protein, 9 aa, Artificial Sequence
  Description of Artificial Sequence: Synthetic peptide
LVVVGASGV

SEQ ID NO: 2258 - protein, 11 aa, Artificial Sequence
  Description of Artificial Sequence: Synthetic peptide
REEYSAMRDQY

SEQ ID NO: 2259 - protein, 8 aa, Artificial Sequence
  Description of Artificial Sequence: Synthetic peptide
RGVGKSAL

SEQ ID NO: 2260 - protein, 9 aa, Artificial Sequence
  Description of Artificial Sequence: Synthetic peptide
TAGLEEYSA

SEQ ID NO: 2261 - protein, 11 aa, Artificial Sequence
  Description of Artificial Sequence: Synthetic peptide
TEYKLVVVGAA

SEQ ID NO: 2262 - protein, 10 aa, Artificial Sequence
  Description of Artificial Sequence: Synthetic peptide
VGAAGVGKSA

SEQ ID NO: 2263 - protein, 8 aa, Artificial Sequence
  Description of Artificial Sequence: Synthetic peptide
VGADGVGK

SEQ ID NO: 2264 - protein, 10 aa, Artificial Sequence
  Description of Artificial Sequence: Synthetic peptide
VGASGVGKSA

SEQ ID NO: 2265 - protein, 10 aa, Artificial Sequence
  Description of Artificial Sequence: Synthetic peptide
VGVGKSALTI

SEQ ID NO: 2266 - protein, 8 aa, Artificial Sequence
  Description of Artificial Sequence: Synthetic peptide
VVVGAAGV

SEQ ID NO: 2267 - protein, 8 aa, Artificial Sequence
  Description of Artificial Sequence: Synthetic peptide
VVVGAVGV

SEQ ID NO: 2268 - protein, 9 aa, Artificial Sequence
  Description of Artificial Sequence: Synthetic peptide
YKLVVVGAC

SEQ ID NO: 2269 - protein, 9 aa, Artificial Sequence
  Description of Artificial Sequence: Synthetic peptide
YKLVVVGAD

SEQ ID NO: 2270 - protein, 9 aa, Artificial Sequence
  Description of Artificial Sequence: Synthetic peptide
YKLVVVGAR

SEQ ID NO: 2271 - protein, 9 aa, Artificial Sequence
  Description of Artificial Sequence: Synthetic peptide
DILDTAGKE

SEQ ID NO: 2272 - protein, 6 aa, Artificial Sequence
  Description of Artificial Sequence: Synthetic peptide
HHHHHH

SEQ ID NO: 2273 - protein, 6 aa, Artificial Sequence
  Description of Artificial Sequence: Synthetic peptide
HHHHHH

SEQ ID NO: 2274 - protein, 10 aa, Artificial Sequence
  Description of Artificial Sequence: Synthetic peptide
VVVGACGVGK

SEQ ID NO: 2275 - protein, 10 aa, Artificial Sequence
  Description of Artificial Sequence: Synthetic peptide
VVVGAVGVGK

SEQ ID NO: 2276 - protein, 9 aa, Artificial Sequence
  Description of Artificial Sequence: Synthetic peptide
VVGAVGVGK

SEQ ID NO: 2277 - protein, 9 aa, Artificial Sequence
  Description of Artificial Sequence: Synthetic peptide
LVVVGACGV

SEQ ID NO: 2278 - protein, 10 aa, Artificial Sequence
  Description of Artificial Sequence: Synthetic peptide
KLVVVGACGV

SEQ ID NO: 2279 - protein, 9 aa, Artificial Sequence
  Description of Artificial Sequence: Synthetic peptide
LVVVGADGV

SEQ ID NO: 2280 - protein, 10 aa, Artificial Sequence
  Description of Artificial Sequence: Synthetic peptide
KLVVVGADGV

SEQ ID NO: 2281 - protein, 9 aa, Artificial Sequence
  Description of Artificial Sequence: Synthetic peptide
LVVVGAVGV

SEQ ID NO: 2282 - protein, 10 aa, Artificial Sequence
  Description of Artificial Sequence: Synthetic peptide
KLVVVGAVGV

SEQ ID NO: 2283 - protein, 9 aa, Artificial Sequence
  Description of Artificial Sequence: Synthetic peptide
VVGACGVGK

SEQ ID NO: 2284 - protein, 10 aa, Artificial Sequence
  Description of Artificial Sequence: Synthetic peptide
VVVGACGVGK

SEQ ID NO: 2285 - protein, 9 aa, Artificial Sequence
  Description of Artificial Sequence: Synthetic peptide
VVGADGVGK

SEQ ID NO: 2286 - protein, 10 aa, Artificial Sequence
  Description of Artificial Sequence: Synthetic peptide
VVVGADGVGK

SEQ ID NO: 2287 - protein, 9 aa, Artificial Sequence
  Description of Artificial Sequence: Synthetic peptide
VVGAVGVGK

SEQ ID NO: 2288 - protein, 10 aa, Artificial Sequence
  Description of Artificial Sequence: Synthetic peptide
VVVGAVGVGK

SEQ ID NO: 2289 - protein, 9 aa, Artificial Sequence
  Description of Artificial Sequence: Synthetic peptide
VVGACGVGK

SEQ ID NO: 2290 - protein, 10 aa, Artificial Sequence
  Description of Artificial Sequence: Synthetic peptide
VVVGACGVGK

SEQ ID NO: 2291 - protein, 9 aa, Artificial Sequence
  Description of Artificial Sequence: Synthetic peptide
VVGADGVGK

SEQ ID NO: 2292 - protein, 10 aa, Artificial Sequence
  Description of Artificial Sequence: Synthetic peptide
VVVGADGVGK

SEQ ID NO: 2293 - protein, 9 aa, Artificial Sequence
  Description of Artificial Sequence: Synthetic peptide
VVGAVGVGK

SEQ ID NO: 2294 - protein, 10 aa, Artificial Sequence
  Description of Artificial Sequence: Synthetic peptide
VVVGAVGVGK

SEQ ID NO: 2295 - protein, 10 aa, Artificial Sequence
  Description of Artificial Sequence: Synthetic peptide
KLVVVGACGV

SEQ ID NO: 2296 - protein, 10 aa, Artificial Sequence
  Description of Artificial Sequence: Synthetic peptide
FLVVVGACGL

SEQ ID NO: 2297 - protein, 10 aa, Artificial Sequence
  Description of Artificial Sequence: Synthetic peptide
FMVVVGACGI

SEQ ID NO: 2298 - protein, 10 aa, Artificial Sequence
  Description of Artificial Sequence: Synthetic peptide
FLVVVGACGI

SEQ ID NO: 2299 - protein, 10 aa, Artificial Sequence
  Description of Artificial Sequence: Synthetic peptide
FMVVVGACGV

SEQ ID NO: 2300 - protein, 10 aa, Artificial Sequence
  Description of Artificial Sequence: Synthetic peptide
FLVVVGACGV

SEQ ID NO: 2301 - protein, 10 aa, Artificial Sequence
  Description of Artificial Sequence: Synthetic peptide
MLVVVGACGV

SEQ ID NO: 2302 - protein, 10 aa, Artificial Sequence
  Description of Artificial Sequence: Synthetic peptide
FMVVVGACGL

SEQ ID NO: 2303 - protein, 10 aa, Artificial Sequence
  Description of Artificial Sequence: Synthetic peptide
YLVVVGACGV

SEQ ID NO: 2304 - protein, 10 aa, Artificial Sequence
  Description of Artificial Sequence: Synthetic peptide
KMVVVGACGV

SEQ ID NO: 2305 - protein, 10 aa, Artificial Sequence
  Description of Artificial Sequence: Synthetic peptide
YMVVVGACGV

SEQ ID NO: 2306 - protein, 10 aa, Artificial Sequence
  Description of Artificial Sequence: Synthetic peptide
MMVVVGACGV

SEQ ID NO: 2307 - protein, 10 aa, Artificial Sequence
  Description of Artificial Sequence: Synthetic peptide
KLVVVGADGV

SEQ ID NO: 2308 - protein, 10 aa, Artificial Sequence
  Description of Artificial Sequence: Synthetic peptide
KLVVVGACGV

SEQ ID NO: 2309 - protein, 10 aa, Artificial Sequence
  Description of Artificial Sequence: Synthetic peptide
KLVVVGAVGV

SEQ ID NO: 2310 - protein, 9 aa, Artificial Sequence
  Description of Artificial Sequence: Synthetic peptide
LVVVGADGV

SEQ ID NO: 2311 - protein, 9 aa, Artificial Sequence
  Description of Artificial Sequence: Synthetic peptide
LVVVGACGV

SEQ ID NO: 2312 - protein, 9 aa, Artificial Sequence
  Description of Artificial Sequence: Synthetic peptide
LVVVGAVGV

SEQ ID NO: 2313 - protein, 10 aa, Artificial Sequence
  Description of Artificial Sequence: Synthetic peptide
GADGVGKSAL

SEQ ID NO: 2314 - protein, 10 aa, Artificial Sequence
  Description of Artificial Sequence: Synthetic peptide
GACGVGKSAL

SEQ ID NO: 2315 - protein, 10 aa, Artificial Sequence
  Description of Artificial Sequence: Synthetic peptide
GAVGVGKSAL

SEQ ID NO: 2316 - protein, 9 aa, Artificial Sequence
  Description of Artificial Sequence: Synthetic peptide
GADGVGKSA

SEQ ID NO: 2317 - protein, 9 aa, Artificial Sequence
  Description of Artificial Sequence: Synthetic peptide
GACGVGKSA

SEQ ID NO: 2318 - protein, 9 aa, Artificial Sequence
  Description of Artificial Sequence: Synthetic peptide
GAVGVGKSA

SEQ ID NO: 2319 - protein, 9 aa, Artificial Sequence
  Description of Artificial Sequence: Synthetic peptide
VVGADGVGK

SEQ ID NO: 2320 - protein, 9 aa, Artificial Sequence
  Description of Artificial Sequence: Synthetic peptide
VVGACGVGK

SEQ ID NO: 2321 - protein, 9 aa, Artificial Sequence
  Description of Artificial Sequence: Synthetic peptide
VVGAVGVGK

SEQ ID NO: 2322 - protein, 10 aa, Artificial Sequence
  Description of Artificial Sequence: Synthetic peptide
VVVGADGVGK

SEQ ID NO: 2323 - protein, 10 aa, Artificial Sequence
  Description of Artificial Sequence: Synthetic peptide
VVVGACGVGK

SEQ ID NO: 2324 - protein, 10 aa, Artificial Sequence
  Description of Artificial Sequence: Synthetic peptide
VVVGAVGVGK

SEQ ID NO: 2325 - protein, 15 aa, Artificial Sequence
  Description of Artificial Sequence: Synthetic peptide
  MOD_RES (8)..(8): Asp, Val, Cys, Ala, Arg or Ser
KLVVVGAXGVGKSAL

SEQ ID NO: 2326 - protein, 19 aa, Artificial Sequence
  Description of Artificial Sequence: Synthetic peptide
KLVVVGAVGVGKSALTIQL

SEQ ID NO: 2327 - protein, 10 aa, Artificial Sequence
  Description of Artificial Sequence: Synthetic peptide
  MOD_RES (1)..(1): Any amino acid except Ala
  MOD_RES (2)..(2): Any amino acid except Glu
  MOD_RES (8)..(8): Asp, Val, Cys, Ala, Arg or Ser
  MOD_RES (10)..(10): Any amino acid
  See specification as filed for detailed description of substitutions and preferred embodiments
XXVVVGAXGX

SEQ ID NO: 2328 - protein, 8 aa, Artificial Sequence
  Description of Artificial Sequence: Synthetic peptide
DTAGHEEY

SEQ ID NO: 2329 - protein, 10 aa, Artificial Sequence
  Description of Artificial Sequence: Synthetic peptide
TAGHEEYSAM

SEQ ID NO: 2330 - protein, 9 aa, Artificial Sequence
  Description of Artificial Sequence: Synthetic peptide
DILDTAGHE

SEQ ID NO: 2331 - protein, 8 aa, Artificial Sequence
  Description of Artificial Sequence: Synthetic peptide
DILDTAGH

SEQ ID NO: 2332 - protein, 9 aa, Artificial Sequence
  Description of Artificial Sequence: Synthetic peptide
ILDTAGHEE

SEQ ID NO: 2333 - protein, 8 aa, Artificial Sequence
  Description of Artificial Sequence: Synthetic peptide
ILDTAGHE

SEQ ID NO: 2334 - protein, 11 aa, Artificial Sequence
  Description of Artificial Sequence: Synthetic peptide
DILDTAGHEEY

SEQ ID NO: 2335 - protein, 9 aa, Artificial Sequence
  Description of Artificial Sequence: Synthetic peptide
DTAGHEEYS

SEQ ID NO: 2336 - protein, 10 aa, Artificial Sequence
  Description of Artificial Sequence: Synthetic peptide
LLDILDTAGH

SEQ ID NO: 2337 - protein, 9 aa, Artificial Sequence
  Description of Artificial Sequence: Synthetic peptide
DILDTAGRE

SEQ ID NO: 2338 - protein, 8 aa, Artificial Sequence
  Description of Artificial Sequence: Synthetic peptide
DILDTAGR

SEQ ID NO: 2339 - protein, 9 aa, Artificial Sequence
  Description of Artificial Sequence: Synthetic peptide
ILDTAGREE

SEQ ID NO: 2340 - protein, 8 aa, Artificial Sequence
  Description of Artificial Sequence: Synthetic peptide
ILDTAGRE

SEQ ID NO: 2341 - protein, 11 aa, Artificial Sequence
  Description of Artificial Sequence: Synthetic peptide
CLLDILDTAGR

SEQ ID NO: 2342 - protein, 10 aa, Artificial Sequence
  Description of Artificial Sequence: Synthetic peptide
TAGREEYSAM

SEQ ID NO: 2343 - protein, 9 aa, Artificial Sequence
  Description of Artificial Sequence: Synthetic peptide
REEYSAMRD

SEQ ID NO: 2344 - protein, 11 aa, Artificial Sequence
  Description of Artificial Sequence: Synthetic peptide
DTAGKEEYSAM

SEQ ID NO: 2345 - protein, 11 aa, Artificial Sequence
  Description of Artificial Sequence: Synthetic peptide
CLLDILDTAGK

SEQ ID NO: 2346 - protein, 8 aa, Artificial Sequence
  Description of Artificial Sequence: Synthetic peptide
DTAGKEEY

SEQ ID NO: 2347 - protein, 10 aa, Artificial Sequence
  Description of Artificial Sequence: Synthetic peptide
LLDILDTAGK

SEQ ID NO: 2348 - protein, 8 aa, Artificial Sequence
  Description of Artificial Sequence: Synthetic peptide
ILDTAGKE

SEQ ID NO: 2349 - protein, 9 aa, Artificial Sequence
  Description of Artificial Sequence: Synthetic peptide
ILDTAGKEE

SEQ ID NO: 2350 - protein, 8 aa, Artificial Sequence
  Description of Artificial Sequence: Synthetic peptide
DTAGLEEY

SEQ ID NO: 2351 - protein, 8 aa, Artificial Sequence
  Description of Artificial Sequence: Synthetic peptide
ILDTAGLE

SEQ ID NO: 2352 - protein, 8 aa, Artificial Sequence
  Description of Artificial Sequence: Synthetic peptide
DILDTAGL

SEQ ID NO: 2353 - protein, 9 aa, Artificial Sequence
  Description of Artificial Sequence: Synthetic peptide
ILDTAGLEE

SEQ ID NO: 2354 - protein, 12 aa, Artificial Sequence
  Description of Artificial Sequence: Synthetic peptide
GLEEYSAMRDQY

SEQ ID NO: 2355 - protein, 11 aa, Artificial Sequence
  Description of Artificial Sequence: Synthetic peptide
LLDILDTAGLE

SEQ ID NO: 2356 - protein, 9 aa, Artificial Sequence
  Description of Artificial Sequence: Synthetic peptide
LDILDTAGL

SEQ ID NO: 2357 - protein, 9 aa, Artificial Sequence
  Description of Artificial Sequence: Synthetic peptide
DILDTAGLE

SEQ ID NO: 2358 - protein, 11 aa, Artificial Sequence
  Description of Artificial Sequence: Synthetic peptide
DILDTAGLEEY

SEQ ID NO: 2359 - protein, 8 aa, Artificial Sequence
  Description of Artificial Sequence: Synthetic peptide
AGVGKSAL

SEQ ID NO: 2360 - protein, 10 aa, Artificial Sequence
  Description of Artificial Sequence: Synthetic peptide
GAAGVGKSAL

SEQ ID NO: 2361 - protein, 9 aa, Artificial Sequence
  Description of Artificial Sequence: Synthetic peptide
AAGVGKSAL

SEQ ID NO: 2362 - protein, 8 aa, Artificial Sequence
  Description of Artificial Sequence: Synthetic peptide
CGVGKSAL

SEQ ID NO: 2363 - protein, 9 aa, Artificial Sequence
  Description of Artificial Sequence: Synthetic peptide
ACGVGKSAL

SEQ ID NO: 2364 - protein, 8 aa, Artificial Sequence
  Description of Artificial Sequence: Synthetic peptide
DGVGKSAL

SEQ ID NO: 2365 - protein, 9 aa, Artificial Sequence
  Description of Artificial Sequence: Synthetic peptide
ADGVGKSAL

SEQ ID NO: 2366 - protein, 10 aa, Artificial Sequence
  Description of Artificial Sequence: Synthetic peptide
DGVGKSALTI

SEQ ID NO: 2367 - protein, 9 aa, Artificial Sequence
  Description of Artificial Sequence: Synthetic peptide
GARGVGKSA

SEQ ID NO: 2368 - protein, 10 aa, Artificial Sequence
  Description of Artificial Sequence: Synthetic peptide
KLVVVGARGV

SEQ ID NO: 2369 - protein, 8 aa, Artificial Sequence
  Description of Artificial Sequence: Synthetic peptide
VVVGARGV

SEQ ID NO: 2370 - protein, 8 aa, Artificial Sequence
  Description of Artificial Sequence: Synthetic peptide
SGVGKSAL

SEQ ID NO: 2371 - protein, 10 aa, Artificial Sequence
  Description of Artificial Sequence: Synthetic peptide
VVVGASGVGK

SEQ ID NO: 2372 - protein, 10 aa, Artificial Sequence
  Description of Artificial Sequence: Synthetic peptide
GASGVGKSAL

SEQ ID NO: 2373 - protein, 8 aa, Artificial Sequence
  Description of Artificial Sequence: Synthetic peptide
VGVGKSAL

SEQ ID NO: 2374 - protein, 10 aa, Artificial Sequence
  Description of Artificial Sequence: Synthetic peptide
VVVGAGCVGK

SEQ ID NO: 2375 - protein, 9 aa, Artificial Sequence
  Description of Artificial Sequence: Synthetic peptide
KLVVVGAGC

SEQ ID NO: 2376 - protein, 8 aa, Artificial Sequence
  Description of Artificial Sequence: Synthetic peptide
GDVGKSAL

SEQ ID NO: 2377 - protein, 9 aa, Artificial Sequence
  Description of Artificial Sequence: Synthetic peptide
DVGKSALTI

SEQ ID NO: 2378 - protein, 10 aa, Artificial Sequence
  Description of Artificial Sequence: Synthetic peptide
VVVGAGDVGK

SEQ ID NO: 2379 - protein, 10 aa, Artificial Sequence
  Description of Artificial Sequence: Synthetic peptide
TAGKEEYSAM

SEQ ID NO: 2380 - protein, 11 aa, Artificial Sequence
  Description of Artificial Sequence: Synthetic peptide
DTAGHEEYSAM

SEQ ID NO: 2381 - protein, 9 aa, Artificial Sequence
  Description of Artificial Sequence: Synthetic peptide
TAGHEEYSA

SEQ ID NO: 2382 - protein, 11 aa, Artificial Sequence
  Description of Artificial Sequence: Synthetic peptide
DTAGREEYSAM

SEQ ID NO: 2383 - protein, 9 aa, Artificial Sequence
  Description of Artificial Sequence: Synthetic peptide
TAGKEEYSA

SEQ ID NO: 2384 - protein, 8 aa, Artificial Sequence
  Description of Artificial Sequence: Synthetic peptide
AAGVGKSA

SEQ ID NO: 2385 - protein, 9 aa, Artificial Sequence
  Description of Artificial Sequence: Synthetic peptide
AGCVGKSAL

SEQ ID NO: 2386 - protein, 9 aa, Artificial Sequence
  Description of Artificial Sequence: Synthetic peptide
AGDVGKSAL

SEQ ID NO: 2387 - protein, 10 aa, Artificial Sequence
  Description of Artificial Sequence: Synthetic peptide
AGKEEYSAMR

SEQ ID NO: 2388 - protein, 10 aa, Artificial Sequence
  Description of Artificial Sequence: Synthetic peptide
AGVGKSALTI

SEQ ID NO: 2389 - protein, 9 aa, Artificial Sequence
  Description of Artificial Sequence: Synthetic peptide
ARGVGKSAL

SEQ ID NO: 2390 - protein, 8 aa, Artificial Sequence
  Description of Artificial Sequence: Synthetic peptide
ASGVGKSA

SEQ ID NO: 2391 - protein, 9 aa, Artificial Sequence
  Description of Artificial Sequence: Synthetic peptide
ASGVGKSAL

SEQ ID NO: 2392 - protein, 8 aa, Artificial Sequence
  Description of Artificial Sequence: Synthetic peptide
AVGVGKSA

SEQ ID NO: 2393 - protein, 9 aa, Artificial Sequence
  Description of Artificial Sequence: Synthetic peptide
CVGKSALTI

SEQ ID NO: 2394 - protein, 8 aa, Artificial Sequence
  Description of Artificial Sequence: Synthetic peptide
DILDTAGK

SEQ ID NO: 2395 - protein, 11 aa, Artificial Sequence
  Description of Artificial Sequence: Synthetic peptide
DILDTAGREEY

SEQ ID NO: 2396 - protein, 12 aa, Artificial Sequence
  Description of Artificial Sequence: Synthetic peptide
DTAGHEEYSAMR

SEQ ID NO: 2397 - protein, 9 aa, Artificial Sequence
  Description of Artificial Sequence: Synthetic peptide
DTAGKEEYS

SEQ ID NO: 2398 - protein, 12 aa, Artificial Sequence
  Description of Artificial Sequence: Synthetic peptide
DTAGKEEYSAMR

SEQ ID NO: 2399 - protein, 9 aa, Artificial Sequence
  Description of Artificial Sequence: Synthetic peptide
DTAGLEEYS

SEQ ID NO: 2400 - protein, 10 aa, Artificial Sequence
  Description of Artificial Sequence: Synthetic peptide
DTAGLEEYSA

SEQ ID NO: 2401 - protein, 12 aa, Artificial Sequence
  Description of Artificial Sequence: Synthetic peptide
DTAGLEEYSAMR

SEQ ID NO: 2402 - protein, 9 aa, Artificial Sequence
  Description of Artificial Sequence: Synthetic peptide
DTAGREEYS

SEQ ID NO: 2403 - protein, 12 aa, Artificial Sequence
  Description of Artificial Sequence: Synthetic peptide
DTAGREEYSAMR

SEQ ID NO: 2404 - protein, 9 aa, Artificial Sequence
  Description of Artificial Sequence: Synthetic peptide
GAAGVGKSA

SEQ ID NO: 2405 - protein, 9 aa, Artificial Sequence
  Description of Artificial Sequence: Synthetic peptide
GACGVGKSA

SEQ ID NO: 2406 - protein, 10 aa, Artificial Sequence
  Description of Artificial Sequence: Synthetic peptide
GACGVGKSAL

SEQ ID NO: 2407 - protein, 8 aa, Artificial Sequence
  Description of Artificial Sequence: Synthetic peptide
GADGVGKS

SEQ ID NO: 2408 - protein, 9 aa, Artificial Sequence
  Description of Artificial Sequence: Synthetic peptide
GAGDVGKSA

SEQ ID NO: 2409 - protein, 10 aa, Artificial Sequence
  Description of Artificial Sequence: Synthetic peptide
GAGDVGKSAL

SEQ ID NO: 2410 - protein, 9 aa, Artificial Sequence
  Description of Artificial Sequence: Synthetic peptide
GASGVGKSA

SEQ ID NO: 2411 - protein, 8 aa, Artificial Sequence
  Description of Artificial Sequence: Synthetic peptide
GCVGKSAL

SEQ ID NO: 2412 - protein, 10 aa, Artificial Sequence
  Description of Artificial Sequence: Synthetic peptide
GCVGKSALTI

SEQ ID NO: 2413 - protein, 8 aa, Artificial Sequence
  Description of Artificial Sequence: Synthetic peptide
GHEEYSAM

SEQ ID NO: 2414 - protein, 8 aa, Artificial Sequence
  Description of Artificial Sequence: Synthetic peptide
GKEEYSAM

SEQ ID NO: 2415 - protein, 9 aa, Artificial Sequence
  Description of Artificial Sequence: Synthetic peptide
GLEEYSAMR

SEQ ID NO: 2416 - protein, 8 aa, Artificial Sequence
  Description of Artificial Sequence: Synthetic peptide
GREEYSAM

SEQ ID NO: 2417 - protein, 9 aa, Artificial Sequence
  Description of Artificial Sequence: Synthetic peptide
GREEYSAMR

SEQ ID NO: 2418 - protein, 9 aa, Artificial Sequence
  Description of Artificial Sequence: Synthetic peptide
HEEYSAMRD

SEQ ID NO: 2419 - protein, 9 aa, Artificial Sequence
  Description of Artificial Sequence: Synthetic peptide
KEEYSAMRD

SEQ ID NO: 2420 - protein, 9 aa, Artificial Sequence
  Description of Artificial Sequence: Synthetic peptide
KLVVVGASG

SEQ ID NO: 2421 - protein, 9 aa, Artificial Sequence
  Description of Artificial Sequence: Synthetic peptide
LDILDTAGR

SEQ ID NO: 2422 - protein, 9 aa, Artificial Sequence
  Description of Artificial Sequence: Synthetic peptide
LEEYSAMRD

SEQ ID NO: 2423 - protein, 9 aa, Artificial Sequence
  Description of Artificial Sequence: Synthetic peptide
LVVVGARGV

SEQ ID NO: 2424 - protein, 9 aa, Artificial Sequence
  Description of Artificial Sequence: Synthetic peptide
LVVVGASGV

SEQ ID NO: 2425 - protein, 11 aa, Artificial Sequence
  Description of Artificial Sequence: Synthetic peptide
REEYSAMRDQY

SEQ ID NO: 2426 - protein, 8 aa, Artificial Sequence
  Description of Artificial Sequence: Synthetic peptide
RGVGKSAL

SEQ ID NO: 2427 - protein, 9 aa, Artificial Sequence
  Description of Artificial Sequence: Synthetic peptide
TAGLEEYSA

SEQ ID NO: 2428 - protein, 11 aa, Artificial Sequence
  Description of Artificial Sequence: Synthetic peptide
TEYKLVVVGAA

SEQ ID NO: 2429 - protein, 10 aa, Artificial Sequence
  Description of Artificial Sequence: Synthetic peptide
VGAAGVGKSA

SEQ ID NO: 2430 - protein, 8 aa, Artificial Sequence
  Description of Artificial Sequence: Synthetic peptide
VGADGVGK

SEQ ID NO: 2431 - protein, 10 aa, Artificial Sequence
  Description of Artificial Sequence: Synthetic peptide
VGASGVGKSA

SEQ ID NO: 2432 - protein, 10 aa, Artificial Sequence
  Description of Artificial Sequence: Synthetic peptide
VGVGKSALTI

SEQ ID NO: 2433 - protein, 8 aa, Artificial Sequence
  Description of Artificial Sequence: Synthetic peptide
VVVGAAGV

SEQ ID NO: 2434 - protein, 8 aa, Artificial Sequence
  Description of Artificial Sequence: Synthetic peptide
VVVGAVGV

SEQ ID NO: 2435 - protein, 9 aa, Artificial Sequence
  Description of Artificial Sequence: Synthetic peptide
YKLVVVGAC

SEQ ID NO: 2436 - protein, 9 aa, Artificial Sequence
  Description of Artificial Sequence: Synthetic peptide
YKLVVVGAD

SEQ ID NO: 2437 - protein, 9 aa, Artificial Sequence
  Description of Artificial Sequence: Synthetic peptide
YKLVVVGAR

SEQ ID NO: 2438 - protein, 9 aa, Artificial Sequence
  Description of Artificial Sequence: Synthetic peptide
DILDTAGKE

SEQ ID NO: 2439 - protein, 9 aa, Artificial Sequence
  Description of Artificial Sequence: Synthetic peptide
LVVVGACGV

SEQ ID NO: 2440 - protein, 10 aa, Artificial Sequence
  Description of Artificial Sequence: Synthetic peptide
KLVVVGACGV

SEQ ID NO: 2441 - protein, 9 aa, Artificial Sequence
  Description of Artificial Sequence: Synthetic peptide
LVVVGADGV

SEQ ID NO: 2442 - protein, 10 aa, Artificial Sequence
  Description of Artificial Sequence: Synthetic peptide
KLVVVGADGV

SEQ ID NO: 2443 - protein, 9 aa, Artificial Sequence
  Description of Artificial Sequence: Synthetic peptide
LVVVGAVGV

SEQ ID NO: 2444 - protein, 10 aa, Artificial Sequence
  Description of Artificial Sequence: Synthetic peptide
KLVVVGAVGV

SEQ ID NO: 2445 - protein, 9 aa, Artificial Sequence
  Description of Artificial Sequence: Synthetic peptide
VVGACGVGK

SEQ ID NO: 2446 - protein, 10 aa, Artificial Sequence
  Description of Artificial Sequence: Synthetic peptide
VVVGACGVGK

SEQ ID NO: 2447 - protein, 9 aa, Artificial Sequence
  Description of Artificial Sequence: Synthetic peptide
VVGADGVGK

SEQ ID NO: 2448 - protein, 10 aa, Artificial Sequence
  Description of Artificial Sequence: Synthetic peptide
VVVGADGVGK

SEQ ID NO: 2449 - protein, 9 aa, Artificial Sequence
  Description of Artificial Sequence: Synthetic peptide
VVGAVGVGK

SEQ ID NO: 2450 - protein, 10 aa, Artificial Sequence
  Description of Artificial Sequence: Synthetic peptide
VVVGAVGVGK

SEQ ID NO: 2451 - protein, 9 aa, Artificial Sequence
  Description of Artificial Sequence: Synthetic peptide
VVGACGVGK

SEQ ID NO: 2452 - protein, 9 aa, Artificial Sequence
  Description of Artificial Sequence: Synthetic peptide
VVGADGVGK

SEQ ID NO: 2453 - protein, 10 aa, Artificial Sequence
  Description of Artificial Sequence: Synthetic peptide
VVVGADGVGK

SEQ ID NO: 2454 - protein, 9 aa, Artificial Sequence
  Description of Artificial Sequence: Synthetic peptide
VVGAVGVGK

SEQ ID NO: 2455 - protein, 10 aa, Artificial Sequence
  Description of Artificial Sequence: Synthetic peptide
VVVGAVGVGK

SEQ ID NO: 2456 - protein, 10 aa, Artificial Sequence
  Description of Artificial Sequence: Synthetic peptide
KLVVVGACGV

SEQ ID NO: 2457 - protein, 10 aa, Artificial Sequence
  Description of Artificial Sequence: Synthetic peptide
FLVVVGACGL

SEQ ID NO: 2458 - protein, 10 aa, Artificial Sequence
  Description of Artificial Sequence: Synthetic peptide
FMVVVGACGI

SEQ ID NO: 2459 - protein, 10 aa, Artificial Sequence
  Description of Artificial Sequence: Synthetic peptide
FLVVVGACGI

SEQ ID NO: 2460 - protein, 10 aa, Artificial Sequence
  Description of Artificial Sequence: Synthetic peptide
FMVVVGACGV

SEQ ID NO: 2461 - protein, 10 aa, Artificial Sequence
  Description of Artificial Sequence: Synthetic peptide
FLVVVGACGV

SEQ ID NO: 2462 - protein, 10 aa, Artificial Sequence
  Description of Artificial Sequence: Synthetic peptide
MLVVVGACGV

SEQ ID NO: 2463 - protein, 10 aa, Artificial Sequence
  Description of Artificial Sequence: Synthetic peptide
FMVVVGACGL

SEQ ID NO: 2464 - protein, 10 aa, Artificial Sequence
  Description of Artificial Sequence: Synthetic peptide
YLVVVGACGV

SEQ ID NO: 2465 - protein, 10 aa, Artificial Sequence
  Description of Artificial Sequence: Synthetic peptide
KMVVVGACGV

SEQ ID NO: 2466 - protein, 10 aa, Artificial Sequence
  Description of Artificial Sequence: Synthetic peptide
YMVVVGACGV

SEQ ID NO: 2467 - protein, 10 aa, Artificial Sequence
  Description of Artificial Sequence: Synthetic peptide
MMVVVGACGV

SEQ ID NO: 2468 - protein, 13 aa, Artificial Sequence
  Description of Artificial Sequence: Synthetic peptide
TEYKLVVVGAVGV

SEQ ID NO: 2469 - protein, 26 aa, Artificial Sequence
  Description of Artificial Sequence: Synthetic peptide
WQAGILARKLVVVGAVGVQGQNLKYQ

SEQ ID NO: 2470 - protein, 25 aa, Artificial Sequence
  Description of Artificial Sequence: Synthetic peptide
HSYTTAEKLVVVGAVGVILGVLLLI

SEQ ID NO: 2471 - protein, 26 aa, Artificial Sequence
  Description of Artificial Sequence: Synthetic peptide
PLTEEKIKKLVVVGAVGVEKEGKISK

SEQ ID NO: 2472 - protein, 30 aa, Artificial Sequence; identical to SEQ ID NO: 166
  Description of Artificial Sequence: Synthetic polypeptide

SEQ ID NO: 2473 - protein, 30 aa, Artificial Sequence; identical to SEQ ID NO: 167
  Description of Artificial Sequence: Synthetic polypeptide

SEQ ID NO: 2474 - protein, 30 aa, Artificial Sequence; identical to SEQ ID NO: 168
  Description of Artificial Sequence: Synthetic polypeptide

SEQ ID NO: 2475 - protein, 30 aa, Artificial Sequence; identical to SEQ ID NO: 169
  Description of Artificial Sequence: Synthetic polypeptide

SEQ ID NO: 2476 - protein, 30 aa, Artificial Sequence; identical to SEQ ID NO: 170
  Description of Artificial Sequence: Synthetic polypeptide

SEQ ID NO: 2477 - protein, 30 aa, Artificial Sequence; identical to SEQ ID NO: 171
  Description of Artificial Sequence: Synthetic polypeptide

SEQ ID NO: 2478 - protein, 10 aa, Artificial Sequence
  Description of Artificial Sequence: Synthetic peptide
IDIIMKIRNA

SEQ ID NO: 2479 - protein, 30 aa, Artificial Sequence; identical to SEQ ID NO: 173
  Description of Artificial Sequence: Synthetic polypeptide

SEQ ID NO: 2480 - protein, 30 aa, Artificial Sequence; identical to SEQ ID NO: 174
  Description of Artificial Sequence: Synthetic polypeptide

SEQ ID NO: 2481 - protein, 30 aa, Artificial Sequence; identical to SEQ ID NO: 175
  Description of Artificial Sequence: Synthetic polypeptide

SEQ ID NO: 2482 - protein, 30 aa, Artificial Sequence; identical to SEQ ID NO: 176
  Description of Artificial Sequence: Synthetic polypeptide

SEQ ID NO: 2483 - protein, 8 aa, Artificial Sequence
  Description of Artificial Sequence: Synthetic peptide
WQAGILAR

SEQ ID NO: 2484 - protein, 7 aa, Artificial Sequence
  Description of Artificial Sequence: Synthetic peptide
HSYTTAE

SEQ ID NO: 2485 - protein, 8 aa, Artificial Sequence
  Description of Artificial Sequence: Synthetic peptide
PLTEEKIK

SEQ ID NO: 2486 - protein, 10 aa, Artificial Sequence
  Description of Artificial Sequence: Synthetic peptide
GALHFKPGSR

SEQ ID NO: 2487 - protein, 10 aa, Artificial Sequence
  Description of Artificial Sequence: Synthetic peptide
RRANKDATAE

SEQ ID NO: 2488 - protein, 10 aa, Artificial Sequence
  Description of Artificial Sequence: Synthetic peptide
KAFISHEEKR

SEQ ID NO: 2489 - protein, 10 aa, Artificial Sequence
  Description of Artificial Sequence: Synthetic peptide
TDLSSRFSKS

SEQ ID NO: 2490 - protein, 10 aa, Artificial Sequence
  Description of Artificial Sequence: Synthetic peptide
FDLGGGTFDV

SEQ ID NO: 2491 - protein, 10 aa, Artificial Sequence
  Description of Artificial Sequence: Synthetic peptide
CLLLHYSVSK

SEQ ID NO: 2492 - protein, 9 aa, Artificial Sequence
  Description of Artificial Sequence: Synthetic peptide
MTEYKLVVV

SEQ ID NO: 2493 - protein, 10 aa, Artificial Sequence
  Description of Artificial Sequence: Synthetic peptide
KKNKKDDIKD

SEQ ID NO: 2494 - protein, 30 aa, Artificial Sequence; identical to SEQ ID NO: 188
  Description of Artificial Sequence: Synthetic polypeptide

SEQ ID NO: 2495 - protein, 30 aa, Artificial Sequence; identical to SEQ ID NO: 189
  Description of Artificial Sequence: Synthetic polypeptide

SEQ ID NO: 2496 - protein, 30 aa, Artificial Sequence; identical to SEQ ID NO: 190
  Description of Artificial Sequence: Synthetic polypeptide

SEQ ID NO: 2497 - protein, 9 aa, Artificial Sequence
  Description of Artificial Sequence: Synthetic peptide
GKSALTIQL

SEQ ID NO: 2498 - protein, 7 aa, Artificial Sequence
  Description of Artificial Sequence: Synthetic peptide
GKSALTI

SEQ ID NO: 2499 - protein, 8 aa, Artificial Sequence
  Description of Artificial Sequence: Synthetic peptide
QGQNLKYQ

SEQ ID NO: 2500 - protein, 8 aa, Artificial Sequence
  Description of Artificial Sequence: Synthetic peptide
ILGVLLLI

SEQ ID NO: 2501 - protein, 8 aa, Artificial Sequence
  Description of Artificial Sequence: Synthetic peptide
EKEGKISK

SEQ ID NO: 2502 - protein, 10 aa, Artificial Sequence
  Description of Artificial Sequence: Synthetic peptide
AASDFIFLVT

SEQ ID NO: 2503 - protein, 10 aa, Artificial Sequence
  Description of Artificial Sequence: Synthetic peptide
KELKQVASPF

SEQ ID NO: 2504 - protein, 10 aa, Artificial Sequence
  Description of Artificial Sequence: Synthetic peptide
KKKLINEKKE

SEQ ID NO: 2505 - protein, 10 aa, Artificial Sequence
  Description of Artificial Sequence: Synthetic peptide
KKCDISLQFF

SEQ ID NO: 2506 - protein, 10 aa, Artificial Sequence
  Description of Artificial Sequence: Synthetic peptide
KSTAGDTHLG

SEQ ID NO: 2507 - protein, 10 aa, Artificial Sequence
  Description of Artificial Sequence: Synthetic peptide
ATFYVAVTVP

SEQ ID NO: 2508 - protein, 30 aa, Artificial Sequence; identical to SEQ ID NO: 202
  Description of Artificial Sequence: Synthetic polypeptide

SEQ ID NO: 2509 - protein, 30 aa, Artificial Sequence; identical to SEQ ID NO: 203
  Description of Artificial Sequence: Synthetic polypeptide

SEQ ID NO: 2510 - protein, 9 aa, Artificial Sequence
  Description of Artificial Sequence: Synthetic peptide
VVGADGVGK

SEQ ID NO: 2511 - protein, 9 aa, Artificial Sequence
  Description of Artificial Sequence: Synthetic peptide
VVGACGVGK

SEQ ID NO: 2512 - protein, 9 aa, Artificial Sequence
  Description of Artificial Sequence: Synthetic peptide
VVGAVGVGK

SEQ ID NO: 2513 - protein, 10 aa, Artificial Sequence
  Description of Artificial Sequence: Synthetic peptide
VVVGADGVGK

SEQ ID NO: 2514 - protein, 10 aa, Artificial Sequence
  Description of Artificial Sequence: Synthetic peptide
VVVGACGVGK

SEQ ID NO: 2515 - protein, 10 aa, Artificial Sequence
  Description of Artificial Sequence: Synthetic peptide
VVVGAVGVGK

SEQ ID NO: 2516 - protein, 10 aa, Artificial Sequence
  Description of Artificial Sequence: Synthetic peptide
GADGVGKSAL

SEQ ID NO: 2517 - protein, 10 aa, Artificial Sequence
  Description of Artificial Sequence: Synthetic peptide
GACGVGKSAL

SEQ ID NO: 2518 - protein, 10 aa, Artificial Sequence
  Description of Artificial Sequence: Synthetic peptide
GAVGVGKSAL

SEQ ID NO: 2519 - protein, 9 aa, Artificial Sequence
  Description of Artificial Sequence: Synthetic peptide
GADGVGKSA

SEQ ID NO: 2520 - protein, 9 aa, Artificial Sequence
  Description of Artificial Sequence: Synthetic peptide
GACGVGKSA

SEQ ID NO: 2521 - protein, 9 aa, Artificial Sequence
  Description of Artificial Sequence: Synthetic peptide
GAVGVGKSA

SEQ ID NO: 2522 - protein, 10 aa, Artificial Sequence
  Description of Artificial Sequence: Synthetic peptide
KLVVVGADGV

SEQ ID NO: 2523 - protein, 10 aa, Artificial Sequence
  Description of Artificial Sequence: Synthetic peptide
KLVVVGACGV

SEQ ID NO: 2524 - protein, 10 aa, Artificial Sequence
  Description of Artificial Sequence: Synthetic peptide
KLVVVGAVGV

SEQ ID NO: 2525 - protein, 9 aa, Artificial Sequence
  Description of Artificial Sequence: Synthetic peptide
LVVVGADGV

SEQ ID NO: 2526 - protein, 9 aa, Artificial Sequence
  Description of Artificial Sequence: Synthetic peptide
LVVVGACGV

SEQ ID NO: 2527 - protein, 9 aa, Artificial Sequence
  Description of Artificial Sequence: Synthetic peptide
LVVVGAVGV

SEQ ID NO: 2528 - protein, 10 aa, Artificial Sequence
  Description of Artificial Sequence: Synthetic peptide
GADGVGKSAL

SEQ ID NO: 2529 - protein, 10 aa, Artificial Sequence
  Description of Artificial Sequence: Synthetic peptide
GACGVGKSAL

SEQ ID NO: 2530 - protein, 10 aa, Artificial Sequence
  Description of Artificial Sequence: Synthetic peptide
GAVGVGKSAL

SEQ ID NO: 2531 - protein, 9 aa, Artificial Sequence
  Description of Artificial Sequence: Synthetic peptide
GADGVGKSA

SEQ ID NO: 2532 - protein, 9 aa, Artificial Sequence
  Description of Artificial Sequence: Synthetic peptide
GACGVGKSA

SEQ ID NO: 2533 - protein, 9 aa, Artificial Sequence
  Description of Artificial Sequence: Synthetic peptide
GAVGVGKSA

SEQ ID NO: 2534 - protein, 9 aa, Artificial Sequence
  Description of Artificial Sequence: Synthetic peptide
VVGADGVGK

SEQ ID NO: 2535 - protein, 9 aa, Artificial Sequence
  Description of Artificial Sequence: Synthetic peptide
VVGACGVGK

SEQ ID NO: 2536 - protein, 9 aa, Artificial Sequence
  Description of Artificial Sequence: Synthetic peptide
VVGAVGVGK

SEQ ID NO: 2537 - protein, 10 aa, Artificial Sequence
  Description of Artificial Sequence: Synthetic peptide
VVVGADGVGK

SEQ ID NO: 2538 - protein, 10 aa, Artificial Sequence
  Description of Artificial Sequence: Synthetic peptide
VVVGACGVGK

SEQ ID NO: 2539 - protein, 10 aa, Artificial Sequence
  Description of Artificial Sequence: Synthetic peptide
VVVGAVGVGK

SEQ ID NO: 2540 - protein, 10 aa, Artificial Sequence
  Description of Artificial Sequence: Synthetic peptide
VVVGACGVGK

SEQ ID NO: 2541 - protein, 10 aa, Artificial Sequence
  Description of Artificial Sequence: Synthetic peptide
VVVGAVGVGK

SEQ ID NO: 2542 - protein, 9 aa, Artificial Sequence
  Description of Artificial Sequence: Synthetic peptide
VVGAVGVGK

SEQ ID NO: 2543 - protein, 188 aa, Artificial Sequence
  Description of Artificial Sequence: Synthetic polypeptide
MTEYKLVVVGACGVGKSALTIQLIQNHFVDEYDPTIEDSYRKQVVIDGETCLLDILDTAGQEEYSAMRDQYMRTGEGFLCVFAINNTKSFEDIHHYREQIKRVKDSEDVPMVLVGNKCDLPSRTVDTKQAQDLARSYGIPFIETSAKTRQGVDDAFYTLVREIRKHKEKMSKDGKKKKKKSKTKCVIM

SEQ ID NO: 2544 - protein, 188 aa, Artificial Sequence
  Description of Artificial Sequence: Synthetic polypeptide
MTEYKLVVVGAVGVGKSALTIQLIQNHFVDEYDPTIEDSYRKQVVIDGETCLLDILDTAGQEEYSAMRDQYMRTGEGFLCVFAINNTKSFEDIHHYREQIKRVKDSEDVPMVLVGNKCDLPSRTVDTKQAQDLARSYGIPFIETSAKTRQGVDDAFYTLVREIRKHKEKMSKDGKKKKKKSKTKCVIM

SEQ ID NO: 2545 - protein, 9 aa, Artificial Sequence
  Description of Artificial Sequence: Synthetic peptide
LVVVGACGV

SEQ ID NO: 2546 - protein, 10 aa, Artificial Sequence
  Description of Artificial Sequence: Synthetic peptide
KLVVVGACGV

SEQ ID NO: 2547 - protein, 9 aa, Artificial Sequence
  Description of Artificial Sequence: Synthetic peptide
LVVVGADGV

SEQ ID NO: 2548 - protein, 10 aa, Artificial Sequence
  Description of Artificial Sequence: Synthetic peptide
KLVVVGADGV

SEQ ID NO: 2549 - protein, 9 aa, Artificial Sequence
  Description of Artificial Sequence: Synthetic peptide
LVVVGAVGV

SEQ ID NO: 2550 - protein, 10 aa, Artificial Sequence
  Description of Artificial Sequence: Synthetic peptide
KLVVVGAVGV

SEQ ID NO: 2551 - protein, 9 aa, Artificial Sequence
  Description of Artificial Sequence: Synthetic peptide
VVGACGVGK

SEQ ID NO: 2552 - protein, 10 aa, Artificial Sequence
  Description of Artificial Sequence: Synthetic peptide
VVVGACGVGK

SEQ ID NO: 2553 - protein, 9 aa, Artificial Sequence
  Description of Artificial Sequence: Synthetic peptide
VVGADGVGK

SEQ ID NO: 2554 - protein, 10 aa, Artificial Sequence
  Description of Artificial Sequence: Synthetic peptide
VVVGADGVGK

SEQ ID NO: 2555 - protein, 9 aa, Artificial Sequence
  Description of Artificial Sequence: Synthetic peptide
VVGAVGVGK

SEQ ID NO: 2556 - protein, 10 aa, Artificial Sequence
  Description of Artificial Sequence: Synthetic peptide
VVVGAVGVGK

SEQ ID NO: 2557 - protein, 9 aa, Artificial Sequence
  Description of Artificial Sequence: Synthetic peptide
VVGACGVGK

SEQ ID NO: 2558 - protein, 10 aa, Artificial Sequence
  Description of Artificial Sequence: Synthetic peptide
VVVGACGVGK

SEQ ID NO: 2559 - protein, 9 aa, Artificial Sequence
  Description of Artificial Sequence: Synthetic peptide
VVGADGVGK

SEQ ID NO: 2560 - protein, 10 aa, Artificial Sequence
  Description of Artificial Sequence: Synthetic peptide
VVVGADGVGK

SEQ ID NO: 2561 - protein, 9 aa, Artificial Sequence
  Description of Artificial Sequence: Synthetic peptide
VVGAVGVGK

SEQ ID NO: 2562 - protein, 10 aa, Artificial Sequence
  Description of Artificial Sequence: Synthetic peptide
VVVGAVGVGK

SEQ ID NO: 2563 - protein, 8 aa, Artificial Sequence
  Description of Artificial Sequence: Synthetic peptide
DGVGKSAL

SEQ ID NO: 2564 - protein, 9 aa, Artificial Sequence
  Description of Artificial Sequence: Synthetic peptide
DGVGKSALT

SEQ ID NO: 2565 - protein, 10 aa, Artificial Sequence
  Description of Artificial Sequence: Synthetic peptide
DGVGKSALTI

SEQ ID NO: 2566 - protein, 20 aa, Artificial Sequence
  Description of Artificial Sequence: Synthetic peptide
TEYKLVVVGAVGVGKSALTI

SEQ ID NO: 2567 - protein, 10 aa, Artificial Sequence
  Description of Artificial Sequence: Synthetic peptide
  MISC_FEATURE (1)..(1): May or may not be present
VVVGAVGVGK

What is claimed is:

1. A composition comprising T cells specific to an HLA-peptide complex comprising at least one mutant RAS peptide sequence, wherein the HLA-peptide complex comprises a protein encoded by an HLA-C03:04 allele, and the at least one mutant RAS peptide sequence consists of

```
                                       (SEQ ID NO: 2064)
GAVGVGKSA.
```

2. The composition of claim 1, wherein the composition comprises:
   (i) T cells specific to a first HLA-peptide complex comprising a first mutant RAS peptide sequence, wherein the first HLA-peptide complex comprises the protein encoded by the HLA-C03:04 allele and the first mutant RAS peptide sequence consists of GAVGVGKSA (SEQ ID NO: 2064); and
   (ii) T cells specific to a second HLA-peptide complex comprising a second mutant RAS peptide sequence selected from the group consisting of

```
                                       (SEQ ID NO: 2034)
VVVGAVGVGK, (SEQ ID NO: 2028)
VVGAVGVGK, (SEQ ID NO: 2032)
GAVGVGKSAL, (SEQ ID NO: 1918)
VVVGADGVGK, (SEQ ID NO: 1950)
VVVGARGVGK, (SEQ ID NO: 1875)
VVVGACGVGK, (SEQ ID NO: 2044)
AVGVGKSAL, (SEQ ID NO: 1900)
GADGVGKSAL
and (SEQ ID NO: 1913)
GADGVGKSA.
```

3. A method of preparing the composition of claim 1, comprising priming T cells with antigen presenting cells (APCs) comprising
   (i) a polypeptide comprising the at least one mutant RAS peptide sequence, wherein
   the polypeptide has the formula $(Xaa_N)_N$-$(Xaa_{RAS})_P$-$(Xaa_C)_C$;
   wherein $(Xaa_{RAS})_P$ comprises the at least one mutant RAS peptide sequence;

N is (i) 0 or (ii) an integer greater than 2 and less than 100;

$(Xaa_N)_N$ is any amino acid sequence heterologous to the mutant RAS protein;

C is (i) 0 or (ii) an integer greater than 2 and less than 100;

$(Xaa_C)_C$ is any amino acid sequence heterologous to the mutant RAS protein;

P is an integer greater than 7;

wherein the polypeptide is not

```
                                       (SEQ ID NO: 20)
KLVVVGAVGVGKSALTIQL;
``` and wherein if N is 0 C is not 0 and if C is 0 N is not 0; or
   (ii) at least one polynucleotide encoding the polypeptide of (i).

4. The method of claim 3, wherein C is 0.

5. The method of claim 3, wherein $(Xaa_N)_N$ is a polylysine sequence.

6. The method of claim 3, wherein N is an integer less than 50.

7. The method of claim 6, wherein N is 2, 3, 4, 5, or 6.

8. The method of claim 3, wherein the T cells and the APCs are autologous to a subject with a cancer, wherein the cancer cells express the at least one mutant RAS peptide sequence.

9. The method of claim 3, further comprising priming the T cells with APCs in the presence of one or more additional mutant RAS peptide sequences, wherein the one or more additional mutant RAS peptide sequences comprises an amino acid sequence of

```
                                       (SEQ ID NO: 2034)
VVVGAVGVGK, (SEQ ID NO: 2028)
VVGAVGVGK, (SEQ ID NO: 2032)
GAVGVGKSAL, (SEQ ID NO: 2044)
AVGVGKSAL, (SEQ ID NO: 1918)
VVVGADGVGK, (SEQ ID NO: 1900)
GADGVGKSAL,
```

```
                                    (SEQ ID NO: 1913)
GADGVGKSA, (SEQ ID NO: 1950)
VVVGARGVGK,
or (SEQ ID NO: 1875)
VVVGACGVGK.
```

10. The method of claim 3, wherein the polypeptide comprises an amino acid sequence of

```
                                    (SEQ ID NO: 191)
GKSALTIQL
or
                                    (SEQ ID NO: 192)
GKSALTI.
```

11. The method of claim 3, wherein the APCs and the T cells are from a peripheral blood mononuclear cell (PBMC) sample of a human subject.

12. A pharmaceutical composition comprising (i) the composition of claim 1; and (ii) a pharmaceutically acceptable excipient.

13. The pharmaceutical composition of claim 12, wherein the T cells comprise CD4+ and CD8+ T cells.

14. A method of preparing the composition of claim 2, the method comprising priming T cells with antigen presenting cells (APCs) comprising: (i) (a) the first mutant RAS peptide sequence; and (i) (b) the second mutant RAS peptide sequence or (ii) APCs comprising one or more polynucleotides encoding the first mutant peptide sequence and the second mutant peptide sequence; wherein:

(a) the APCs express a protein encoded by an HLA-A03:01 or HLA-A30:01 allele and the second mutant RAS peptide sequence comprises

```
                                    (SEQ ID NO: 2034)
VVVGAVGVGK;
```

(b) the APCs express a protein encoded by an HLA-A30:01 or HLA-A68:01 allele and the second mutant RAS peptide sequence comprises

```
                                    (SEQ ID NO: 2028)
VVGAVGVGK;
```

(c) the APCs express a protein encoded by an HLA-C03:03, or HLA-C03:04 allele and the second mutant RAS peptide sequence comprises

```
                                    (SEQ ID NO: 2032)
GAVGVGKSAL;
```

(d) the APCs express a protein encoded by an HLA-A03:01 or HLA-A68:01 allele and the second mutant RAS peptide sequence comprises

```
                                    (SEQ ID NO: 1918)
VVVGADGVGK;
```

(e) the APCs express a protein encoded by an HLA-A03:01, HLA-A30:01 or HLA-A68:01 allele and the second mutant RAS peptide sequence comprises

```
                                    (SEQ ID NO: 1950)
VVVGARGVGK;
```

(f) the APCs express a protein encoded by an HLA-A03:01 or HLA-A68:01 allele and the second mutant RAS peptide sequence comprise:

```
                                    (SEQ ID NO: 1875)
VVVGACGVGK;
```

(g) the APCs express a protein encoded by an HLA-C01:02 allele and the second mutant RAS peptide sequence comprises

```
                                    (SEQ ID NO: 2044)
AVGVGKSAL;
``` or (h) the APCs express a protein encoded by an HLA-C08:02 allele and the second mutant RAS peptide sequence comprises

```
                                    (SEQ ID NO: 1900)
GADGVGKSAL
or
                                    (SEQ ID NO: 1913)
GADGVGKSA.
```

15. The method of claim 3, wherein the at least one polynucleotide encoding the polypeptide is RNA.

16. The method of claim 3, wherein the T cells are from a human subject with a cancer that expresses the at least one mutant RAS peptide sequence and wherein the human subject's genome comprises an HLA-allele encoding the HLA protein of the HLA-peptide complex.

17. A method of treating a human subject with a cancer comprising: administering to the subject a therapeutically effective amount of the pharmaceutical composition of claim 12.

18. The method of claim 17, wherein the cancer is a KRAS-mutated cancer selected from non-small cell lung cancer, pancreatic cancer and colorectal cancer.

19. The method of claim 3, wherein the APCs express a protein encoded by the HLA-C03:04 allele.

* * * * *